United States Patent
Karicheti et al.

(10) Patent No.: US 7,258,971 B2
(45) Date of Patent: Aug. 21, 2007

(54) METHODS AND COMPOSITIONS FOR TREATING UROLOGICAL DISORDERS USING CARBOXYPEPTIDASE Z IDENTIFIED AS 8263

(75) Inventors: Venkateswarlu Karicheti, Chapel Hill, NC (US); Inmaculada Silos-Santiago, Del Mar, CA (US); Scott D. Eliasof, Lexington, MA (US)

(73) Assignee: Bayer HealthCare AG, Leverkusen (DE)

( * ) Notice: Subject to any disclaimer, the term of this patent is extended or adjusted under 35 U.S.C. 154(b) by 0 days.

(21) Appl. No.: 10/757,262

(22) Filed: Jan. 14, 2004

(65) Prior Publication Data

US 2004/0197825 A1    Oct. 7, 2004

Related U.S. Application Data

(60) Provisional application No. 60/491,156, filed on Jul. 30, 2003.

(51) Int. Cl.
*C12Q 1/00* (2006.01)
*A61K 39/00* (2006.01)

(52) U.S. Cl. .................. 435/4; 424/146.1; 435/183
(58) Field of Classification Search ............ 514/2, 514/12; 530/300, 350
See application file for complete search history.

(56) References Cited

U.S. PATENT DOCUMENTS

2003/0073623 A1    4/2003  Drmanac et al.
2004/0076955 A1*   4/2004  Mack et al. ............. 435/6

FOREIGN PATENT DOCUMENTS

EP     1 293 569 A2      3/2003
WO     WO 01/92581 A2   12/2001

OTHER PUBLICATIONS

Song and Fricker. Journal of Biological Chemistry vol. 272, No. 16, pp. 10543-10550 (1997).*
Lin et al., "Effect of simulated birth trauma on the urinary continence mechanism in the rat", Urology 52(1): 143-151 (1998).*
Shaker et al., "Urinary bladder hyperreflexia: a rat animal model", Neurology and Urodynamics 22: 693-698 (2003).*
Hirotsu et al., "Effect of muscarinic agonist on overflow incontinence induced by bilateral pelvic nerve transection in rats", Jpn. J. Pharmacol. 76: 109-111 (1998).*
De Groat, William, C., "A Neurologic Basis for the Overactive Bladder", Urology, vol. 50, Supplement 6A, (Dec. 1997), pp. 36-52.

* cited by examiner

Primary Examiner—Kathleen Kerr Bragdon
Assistant Examiner—Anand Desai
(74) Attorney, Agent, or Firm—Banner & Witcoff, Ltd.

(57) ABSTRACT

The present invention relates to methods for the diagnosis and treatment of a urological disorder or urological disorders. Specifically, the present invention identifies the differential expression of Carboxypeptidase Z, identified as "8263" gene in tissues relating to urological disorder, relative to their expression in normal, or non-urological disorder disease states, and/or in response to manipulations relevant to a urological disorder. The present invention describes methods for the diagnostic evaluation and prognosis of various urological diseases, and for the identification of subjects exhibiting a predisposition to such conditions. The invention also provides methods for identifying a compound capable of modulating a urological disorder or urological disorders. The present invention also provides methods for the identification and therapeutic use of compounds as treatments of urological disorders.

7 Claims, No Drawings

METHODS AND COMPOSITIONS FOR TREATING UROLOGICAL DISORDERS USING CARBOXYPEPTIDASE Z IDENTIFIED AS 8263

RELATED APPLICATIONS

The present application claims the benefit of U.S. Provisional Application Ser. No. 60/491,156, filed on Jul. 30, 2003. The entire contents of this provisional patent application is hereby incorporated in its entirety by reference.

The entire contents of U.S. Provisional Application Ser. No. 60/440,318, filed on Jan. 15, 2003, of U.S. Provisional Application Ser. No. 60/444,783, filed on Feb. 4, 2003, of U.S. Provisional Application Ser. No. 60/457,90 1, filed on Mar. 27, 2003, of U.S. Provisional Application Ser. No. 60/468,775, filed on May 8, 2003, of U.S. Provisional Application Ser. No. 60/471,614, filed on May 19, 2003, of U.S. Provisional Application Ser. No. 60/478,742, filed on Jun. 16, 2003, of U.S. Provisional Application Ser. No. 60/488,529, filed on Jul. 18, 2003, of U.S. Provisional Application Ser. No. 60/491,156, filed on Jul. 30, 2003, of U.S. Provisional Application Ser. No. 60/499,594, filed on Sep. 2, 2003, and of U.S. Provisional Application Ser. No. 60/506,332, filed on Sep. 26, 2003 are hereby incorporated in their entirety by reference.

BACKGROUND OF THE INVENTION

There are several types of urinary incontinence (UI), the two most common ones being stress urinary incontinence (SUI) and urge urinary incontinence (UUI). SUI can co-exist with UUI and is then referred to as mixed urinary incontinence. UUI is part of a complex known as overactive or oversensitive bladder, which include symptoms of frequency and/or urgency with or without UUI. 75% of patients with incontinence are elderly females.

Bladder overactivity may result from detrusor instability or hyperreflexia. Triggers may include increased activity of afferent peripheral nerve terminals in the bladder or decreased inhibitory control in the central nervous system (CNS) and/or in peripheral ganglia. Changes in detrusor muscle structure or function, such as increased muscle cell excitability due to denervation, may also play a role in the pathogenesis of this filling disorder.

Benign prostatic hyperplasia (BPH) is a common age-related pathological condition that affects men worldwide. At 60 years of age, at least 25% have symptoms of BPH. The symptoms of BPH are currently referred to as lower urinary tract symptoms (LUTS). LUTS are traditionally divided into obstructive (weak stream, intermittency, straining, etc.) and irritative (frequency, nocturia, urgency, etc.) symptoms. They are caused by at least three pathophysiological components, i.e., static, dynamic and bladder detrusor-related. Prostate enlargement, or more specifically benign prostatic nodular enlargement, accounts for much of the static obstructive element and in the elderly male is mainly confined to the transition zone and periurethral glandular tissue. By contrast the dynamic component is a reflection of smooth muscle tone in the prostate and the bladder neck. Variations in muscle tone cause corresponding changes in the degree of outlet obstruction. Bladder and detrusor-related components are believed to predominate in those with principally irritative symptoms. They reflect an increase in the incidence of uninhibited detrusor contractions and at the same time a loss of contractile ability of the bladder, both of which are a response to existing obstruction.

There is an unmet medical need for therapeutics useful for UI and BPH.

DETAILED DESCRIPTION OF THE INVENTION

The present invention provides methods and compositions for the diagnosis and treatment of urological disorders, including but not limited to UI and BPH. Urological disorders as used herein can be diseases of the bladder including but not limited to urinary incontinence including overactive/oversensitive bladder, overflow urinary incontinence, stress urinary incontinence caused by dysfunction of the bladder, urethra or central/peripheral nervous system.

As used herein a urological disorder can be a disorder of the prostate including but not limited to "a prostate disorder" which refers to an abnormal condition occurring in the male pelvic region characterized by, e.g., male sexual dysfunction and/or urinary symptoms. This disorder may be manifested in the form of genitourinary inflammation (e.g., inflammation of smooth muscle cells) as in several common diseases of the prostate including prostatitis, benign prostatic hyperplasia and cancer, e.g., adenocarcinoma or carcinoma, of the prostate.

As used herein a urological disorder can be a disorder of the kidney including but not limited to congenital anomalies including, but not limited to, cystic diseases of the kidney, that include but are not limited to, cystic renal dysplasia, autosomal dominant (adult) polycystic kidney disease, autosomal recessive (childhood) polycystic kidney disease, and cystic diseases of renal medulla, which include, but are not limited to, medullary sponge kidney, and nephronophthisis-uremic medullary cystic disease complex, acquired (dialysis-associated) cystic disease, such as simple cysts; glomerular diseases including pathologies of glomerular injury that include, but are not limited to, in situ immune complex deposition, that includes, but is not limited to, anti-GBM nephritis, Heymann nephritis, and antibodies against planted antigens, circulating immune complex nephritis, antibodies to glomerular cells, cell-mediated immunity in glomerulonephritis, activation of alternative complement pathway, epithelial cell injury, and pathologies involving mediators of glomerular injury including cellular and soluble mediators, acute glomerulonephritis, such as acute proliferative (post-streptococcal, postinfectious) glomerulonephritis, including but not limited to, poststreptococcal glomerulonephritis and nonstreptococcal acute glomerulonephritis, rapidly progressive (crescentic) glomerulonephritis, nephrotic syndrome, membranous glomerulonephritis (membranous nephropathy), minimal change disease (lipoid nephrosis), focal segmental glomerulosclerosis, membranoproliferative glomerulonephritis, IgA nephropathy (Berger disease), focal proliferative and necrotizing glomerulonephritis (focal glomerulonephritis), hereditary nephritis, including but not limited to, Alport syndrome and thin membrane disease (benign familial hematuria), chronic glomerulonephritis, glomerular lesions associated with systemic disease, including but not limited to, systemic lupus erythematosus, Henoch-Schönlein purpura, bacterial endocarditis, diabetic glomerulosclerosis, amyloidosis, fibrillary and immunotactoid glomerulonephritis, and other systemic disorders; diseases affecting tubules and interstitium, including acute tubular necrosis and tubulointerstitial nephritis, including but not limited to, pyelonephritis and urinary tract infection, acute pyelonephritis, chronic pyelonephritis and reflux nephropathy, and tubulointerstitial nephritis induced by drugs and toxins, including but not limited to, acute drug-induced interstitial nephritis, analgesic abuse nephropathy, nephropathy associated with nonsteroidal anti-inflammatory drugs, and other tubulointerstitial diseases including, but not limited to, urate nephropathy, hypercalcemia and nephrocalcinosis, and multiple myeloma; diseases of blood vessels including benign nephrosclerosis, malignant hypertension and accelerated nephrosclerosis, renal artery stenosis, and thrombotic microangiopathies including, but not limited to, classic (childhood) hemolytic-uremic syndrome, adult hemolytic-uremic syndrome/thrombotic thrombocytopenic purpura, idiopathic HUS/TTP, and other vascular disorders including, but not limited to, atherosclerotic ischemic renal disease, atheroembolic renal disease, sickle cell disease nephropathy, diffuse cortical necrosis, and renal infarcts; urinary tract obstruction (obstructive uropathy); urolithiasis (renal calculi, stones); and tumors of the kidney including, but not limited to, benign tumors, such as renal papillary adenoma, renal fibroma or hamartoma (renomedullary interstitial cell tumor), angiomyolipoma, and oncocytoma, and malignant tumors, including renal cell carcinoma (hypemephroma, adenocarcinoma of kidney), which includes urothelial carcinomas of renal pelvis.

"Treatment", as used herein, is defined as the application or administration of a therapeutic agent to a patient, or application or administration of a therapeutic agent to an isolated tissue or cell line from a patient, who has a disease or disorder, a symptom of disease or disorder or a predisposition toward a disease or disorder, with the purpose of curing, healing, alleviating, relieving, altering, remedying, ameliorating, improving or affecting the disease or disorder, at least one symptom of disease or disorder or the predisposition toward a disease or disorder. A therapeutic agent includes, but is not limited to, small molecules, peptides, antibodies, ribozymes and antisense oligonucleotides. Representative molecules are described herein.

The present invention is based, at least in part, on the discovery that nucleic acid and protein molecules, (described infra), are differentially expressed in disease states relative to their expression in normal, or non-disease states. The modulators of the molecules of the present invention, identified according to the methods of the invention can be used to modulate (e.g., inhibit, treat, or prevent) or diagnose a disease, including, but not limited to, UI and BPH.

"Differential expression", as used herein, includes both quantitative as well as qualitative differences in the temporal and/or tissue expression pattern of a gene. Thus, a differentially expressed gene may have its expression activated or inactivated in normal versus disease conditions. The degree to which expression differs in normal versus disease or control versus experimental states need only be large enough to be visualized via standard characterization techniques, e.g., quantitative PCR, Northern analysis, subtractive hybridization. The expression pattern of a differentially expressed gene may be used as part of a prognostic or diagnostic a disease, e.g., UI and BPH, evaluation, or may be used in methods for identifying compounds useful for the treatment of a disease, e.g., UI or BPH. In addition, a differentially expressed gene involved in a disease may represent a target gene such that modulation of the level of target gene expression or of target gene product activity will act to cure, heal, alleviate, relieve, alter, remedy, ameliorate, improve or affect a disease condition, e.g., UI and/or BPH. Compounds that modulate target gene expression or activity of the target gene product can be used in the treatment of a disease. Although the genes described herein may be differentially expressed with respect to a disease, and/or their products may interact with gene products important to a disease, the genes may also be involved in mechanisms important to additional disease cell processes.

"Urological cell", as used herein, includes but is not limited to a bladder cell, a prostate cell, a kidney cell, a vascular cell, a urethral cell or a cell of the central/peripheral nervous system (for example, dorsal root ganglion, trigeminal ganglion, brain or spinal cord).

Molecules of the Present Invention

The molecules of the present invention include but are not limited to the following classifications: G protein coupled receptors (GPCRs). GPCRs of lipid mediators and ligand-gated ion channels have been implicated in increased afferent nerve activity, especially in c-fibers. Enzymes catabolizing/metabolizing neurotransmitters, neurotransmitter/peptide hormone GPCRs, proteases/peptidases and transporters have been shown to participate in a) decreased inhibitory control in CNS/peripheral ganglia, b) increased excitatory neurotransmission in CNS/peripheral ganglia, and c) increased sensitivity to efferent stimulation in the detrusor. Enzymes catabolizing/metabolizing cAMP/cGMP, ligand-gated ion channels, $Ca^{2+}/K^+$ channels, Ser/Thr-kinases and ATPases have been implicated in myogenic regulation of bladder smooth muscle contraction. Involvement of neurotransmitter GPCRs and enzymes catabolizing/metabolizing cAMP/cGMP has been demonstrated in neurological and myogenic regulation of the storage reflex of the bladder.

Peptide hormone GPCRs, proteinases/peptidases, enzymes catabolizing/metabolizing steroids and nuclear hormone receptors have been shown to be involved in the endocrine regulation of testosterone production. Receptor tyrosine kinases and Ser/Thr-kinases have been implicated in mediating the initial epithelial growth in BPH through stromal cell-derived growth factors and local factors. Peptide hormone/neurotransmitter GPCRs and transporters have been demonstrated to mediate the neurological regulation of the smooth muscle tone. Enzymes catabolizing/metabolizing cAMP/cGMP, ligand-gated ion channels, $Ca^{2+}/K^+$ channels, ATPases have been implicated in myogenic regulation of smooth muscle tone in the prostate.

Gene ID 44390

The human 44390 sequence, known also as low affinity sodium-glucose cotransporter SGLT3 (also known as SAAT1), (SEQ ID NO:1), is approximately 2043 nucleotides long including untranslated regions. The coding sequence, located at about nucleic acid 17 to 1996 of SEQ ID NO:1, encodes a 659 amino acid protein (SEQ ID NO:2).

As assessed by TaqMan expression, 44390 mRNA was expressed at relatively high levels in prostate BPH followed by brain, small intestine and colon (Prostate BPH>Brain, small intestine, colon>other tissues). Additional TaqMan experiments indicated that 44390 mRNA was expressed at high levels and up regulated in five out of eleven BPH samples including peripheral and transitional zone samples compared to normal prostate.

In situ hybridization (ISH) experiments performed using a human 44390 probe showed 44390 mRNA expression in human, monkey and rat prostate samples. Normal human prostate and BPH samples showed very clear expression in the epithelial layer. In rat dorsal root ganglia (DRG), 44390 mRNA expression was observed in neurons of all sizes.

44390 is known as the low affinity sodium-glucose cotransporter SGLT3 (or SAAT1). SGLT3 has a low affinity for sugars but has a high selectivity for D-glucose. Inhibition of glucose uptake increases apoptosis in interleukin 3 dependent cell line. SGLT3 mRNA expression levels are increased in liver and lung cancers, thereby implicating a role of SGLT3 in cell proliferation. Therefore, blocking the activity of 44390 reduces the glucose uptake and leads to cellular apoptosis. Based on high expression levels of 44390 mRNA in prostate and up-regulation in BPH, 44390 is a unique target and is useful in reducing the symptoms of BPH.

Due to 44390 expression in prostate BPH samples, modulators of 44390 activity would be useful in treating urological disorders including but not limited to BPH and urinary incontinence. 44390 polypeptides of the current invention would be useful in screening for modulators of 44390 activity.

Gene ID 54181

The human 54181 sequence, known also as peptidylarginine deiminase type III (PAD-III) (SEQ ID NO:3), is approximately 3183 nucleotides long including untranslated regions. The coding sequence, located at about nucleic acid 42 to 2036 of SEQ ID NO:3, encodes a 664 amino acid protein (SEQ ID NO:4).

As assessed by TaqMan analysis, 54181 mRNA was expressed at high levels in normal and UI bladder tissue samples. Additional TaqMan experiments indicated that 54181 mRNA was expressed in 13 out of 17 bladder samples, including UI samples, in male subjects with ages ranging from 33 to 78 years. 54181 mRNA was also expressed in 14 out of 15 bladder samples, including UI samples, in female subjects with ages ranging from 41 to 85 years. 54181 mRNA was also expressed in both smooth muscle and epithelium with higher expression in epithelium than in smooth muscle cells.

ISH experiments showed 54181 mRNA expression in DRG samples of monkey and rat and in bladder samples of human, monkey and rat. In monkey and rat DRG, 54181 mRNA expression was observed in neurons of all sizes. In human, monkey and rat bladder samples, 54181 mRNA was clearly expressed in urothelium.

54181 is peptidylarginine deiminase type III (PAD-III). PADs catalyze the post-translational modification of proteins through the conversion of arginine to citrulline in the presence of calcium ions. 54181 or PAD-III shows high activity towards substrate protamine. Protamine is known to cause vasodilatation. Protamine was also shown to decrease agonist-induced contraction in tracheal smooth muscle tone by inhibiting calcium channels. In addition, protamine inhibits contractions induced by norepinephrine or elevated potassium in rabbit mesenteric artery. Therefore, blocking the activity of 54181 with antagonists increases the endogenous levels of protamine. Increased protamine levels leads to smooth muscle relaxation or reduction of bladder smooth muscle tone. Therefore, 54181 is a unique target to control overactive bladder and UI.

Due to 54181 expression in normal and UI bladder tissue samples and its functional role, modulating the activity of 54181 would modulate smooth muscle tone in the UI bladder. Modulators of 54181 activity would be useful in treating urological disorders including but not limited to urinary incontinence. 54181 polypeptides of the current invention would be useful in screening for modulators of 54181 activity.

Gene ID 211

The human 211 sequence, also known as cholecystokinin type A receptor (CCK-A receptor, CCK-AR) (SEQ ID NO:5), is approximately 1393 nucleotides long including untranslated regions. The coding sequence, located at about nucleic acid 72 to 1358 of SEQ ID NO:5, encodes a 428 amino acid protein (SEQ ID NO:6).

As assessed by TaqMan analysis, 211 mRNA showed restricted expression in brain, spinal cord and DRG. 211 mRNA expression levels were highest in primary osteoblasts followed by DRG, brain and spinal cord. Rat TaqMan panels showed restricted and high expression of 211 mRNA in the DRG. Additional rat panels also showed that 211 mRNA expression is not regulated in DRG in urology animal models. However, the 211 ligand known as cholecystokinin was up regulated in Spinal Cord Injury (SCI) models and aged urology animal models.

211 is a GPCR whose natural ligand is cholecystokinin, a neuropeptide. GPCRs are the receptors for different families of neuropeptides. Neuropeptides are key players in modulating sensory responses.

Based on the selective and restricted expression of 211 mRNA in the DRG, modulating the activity of 211 can alter urinary bladder reflex and/or hyperreflexia and can be a unique target for urinary incontinence. Modulators of 211 activity would be useful in treating urological disorders, including but not limited to urinary incontinence. 211 polypeptides of the current invention would be useful in screening for modulators of 211 activity.

Gene ID 5687

The human 5687 sequence, known also as neuropeptide FF receptor 2 (NPFF2) (SEQ ID NO:7), is approximately 1936 nucleotides long including untranslated regions. The coding sequence, located at about nucleic acid 99 to 1667 of SEQ ID NO:7, encodes a 522 amino acid protein (SEQ ID NO:8).

As assessed by TaqMan analysis, 5687 mRNA was expressed in the brain cortex, hypothalamus, spinal cord, DRG and brain. 5687 mRNA expression in DRG was up regulated in SCI models, cystitis and spontaneously hypertensive rat (SHR) models.

ISH experiments performed with a human 5687 probe showed that 5687 mRNA was expressed in monkey brain and DRG. In the brain, 5687 mRNA was mainly expressed in the cortex. In monkey DRG, expression was observed in a very restricted sub-population of small diameter and medium diameter neurons.

GPCRs are the receptors for different families of neuropeptides. Neuropeptides are key players in modulating sensory responses. 5687 or NPFF2 is the receptor for neuropeptide AF (NPAF, A-18-F-Amide) and neuropeptide FF (NPFF, F-8-F-Amide), also known as morphine-modulating peptides. 5687 can also be activated by a variety of naturally occurring or synthetic Phe-Met-Arg-Phe-NH2 (FMRF-Amide) like ligands. This receptor mediates its action by association with G proteins that activate a phosphatidylinositol calcium second messenger system. NPFF is implicated in nociception and in the modulation of opiate induced analgesia.

Due to 5687 mRNA expression in the brain cortex, hypothalamus, spinal cord, DRG and brain, modulators 5687 activity would be useful in treating urological disorders including but not limited to BPH and urinary incontinence. 5687 polypeptides of the current invention would be useful in screening for modulators of 5687 activity.

Gene ID 884

The human 884 sequence, known also as functional glycine receptor a1 subunit (SEQ ID NO:9), is approximately 1715 nucleotides long including untranslated regions. The coding sequence, located at about nucleic acid 297 to 1646 of SEQ ID NO:9, encodes a 449 amino acid protein (SEQ ID NO:10).

As assessed by TaqMan analysis, 884 mRNA was expressed in the brain, spinal cord and DRG. Further TaqMan analysis indicated that 884 mRNA expression in DRG was up regulated in aged and SHR rat models.

ISH experiments showed 884 mRNA expression in rat brain and all spinal cord neurons. 884 mRNA was also expressed in monkey and human bladders, probably in the smooth muscle.

Glycine is a major inhibitory neurotransmitter in the DRG. Intracisternal glycine, but not gamma aminobutyric acid (GABA), activates a series of neurogenic rhythmic contractions of the urinary bladder in urethane-anaesthetized rats that are inhibited by the glycine receptor inhibitor strychnine (*J Pharm Pharmacol.* 37(7):517-20). In addition, a strychnine-sensitive mechanism contributes to the suppression of sphincter activity normally observed during voiding which may be partly due to a direct glycinergic inhibition of the external urethral sphincter motoneurons (*Exp Brain Res.* 119(3):297-306). Binding of ligand to 884 increases the conductance to anions (e.g., chloride) leading to membrane hyperpolarization, which in turn reduces the neuronal firing.

Given the role of glycine receptors in micturition, drugs that modulate the function of 884 may change the activity of neuronal pathways involved in urinary bladder function, bladder reflex and/or hyperreflexia. Therefore, 884 may be a unique target for urinary incontinence. Modulators of 884 activity would be useful in treating urological disorders including but not limited to urinary incontinence. 884 polypeptides of the current invention would be useful in screening for modulators of 884 activity.

Gene ID 1405

The human 1405 sequence, also known as retinal guanylyl cyclase 1 (retGC or guanylate cyclase 2D) (SEQ ID NO:11), is approximately 3621 nucleotides long including untranslated regions. The coding sequence, located at about nucleic acid 74 to 3385 of SEQ ID NO:11, encodes an 1103 amino acid protein (SEQ ID NO:12).

As assessed by TaqMan analysis, 1405 mRNA was expressed in DRG followed by brain, prostate and breast. (DRG>>Brain>prostate, breast>>other tissues).

RetGC is involved in the resynthesis of cGMP using GTP as substrate in phototransduction. cGMP is a second messenger molecule involved in multiple cellular activities through PKG, PDE pathway and affecting CNG channel function. The cGMP may alter the neuronal excitability in DRG neurons by modulating the activity of various ion channels.

Based on the selective and restricted expression of 1405 in the DRG, brain and prostate, modulating the activity of 1405 can alter urinary bladder reflex and/or hyperreflexia and can be a unique target for urinary incontinence. Modulators of 1405 activity would be useful in treating urological disorders, including but not limited to BPH and urinary incontinence. 1405 polypeptides of the current invention would be useful in screening for modulators of 1405 activity.

Gene ID 636

The human 636 sequence, known also as voltage-gated potassium channel Kv1.6, (SEQ ID NO:13), is approximately 4234 nucleotides long including untranslated regions. The coding sequence, located at about nucleic acid 863 to 2452 of SEQ ID NO:13, encodes a 529 amino acid protein (SEQ ID NO:14).

As assessed by TaqMan analysis, 636 mRNA was expressed mostly in the CNS tissues of rat and human samples. Further TaqMan analysis indicated that 636 mRNA was expressed at high levels in the DRG. 636 mRNA was also down regulated in aged rats when compared to young rats.

ISH experiments indicated that 636 mRNA was expressed in the spinal cord, brain, and a sub-population of DRG neurons in both monkey and rat samples.

636 potentially plays an important role in urinary incontinence. It is present at high levels in the DRG and is down regulated in aged rats. Openers of 636 would cause membrane hyperpolarization by allowing an influx of potassium ions, which in turn would reduce transmission from the DRG to the bladder smooth muscle. Therefore, drugs that open 636 could be a novel method for the inhibition of urinary incontinence.

Due to 636 expression in the CNS and DRG, modulators 636 activity would be useful in treating urological disorders including but not limited to urinary incontinence. 636 polypeptides of the current invention would be useful in screening for modulators of 636 activity.

Gene ID 4421

The human 4421 sequence, known also as T-type calcium channel alpha-1G subunit (CaV3.1) (SEQ ID NO:15), is approximately 7648 nucleotides long including untranslated regions. The coding sequence, located at about nucleic acid 1 to 7134 of SEQ ID NO:15, encodes a 2377 amino acid protein (SEQ ID NO:16).

As assessed by TaqMan analysis, 4421 mRNA was expressed primarily in CNS and prostate tissues. 4421 mRNA was also up regulated in BPH.

T-type calcium channels allow for the influx of calcium ions and are known to play a critical role in smooth muscle contraction. Furthermore, calcium influx through calcium channels is an important component of depolarization in smooth muscle. Inhibition of 4421 would inhibit calcium influx into prostate stromal cells and thus reduce muscle contraction directly and by inhibiting smooth muscle depolarization. Because 4421 is up regulated in BPH, inhibitors of 4421 would therefore relax smooth muscle tone in the BPH prostate.

Based on the selective and restricted expression of 4421 in CNS and prostate tissues, 4421 would represent a unique target for BPH. Modulators of 4421 activity would be useful in treating urological disorders including but not limited to BPH. 4421 polypeptides of the current invention would be useful in screening for modulators of 4421 activity.

Gene ID 5410

The human 5410 sequence, also known as receptor-like kinase Ror2 (SEQ ID NO:17), is approximately 4092 nucleotides long including untranslated regions. The coding sequence, located at about nucleic acid 200 to 3031 of SEQ ID NO:17, encodes a 943 amino acid protein (SEQ ID NO:18).

As assessed by TaqMan analysis, 5410 mRNA was expressed at highest levels in prostate and in lesser amounts in the bladder, breast, intestine and veins. 5410 mRNA was also down regulated in BPH when compared to normal prostate.

5410 contains a kinase domain as well as a Frizzled domain. Wnt proteins bind to receptors of the Frizzled family on the cell surface (*EMBO J* 18(24):6867-72). Wnt proteins function in part via cell surface receptors to stimulate an increase in intracellular Ca2+, possibly through the activation of G proteins (*Oncogene* 18(55):7860-72). Calcium influx causes smooth muscle contraction, therefore inhibition of 5410 would relax smooth muscle in BPH. In addition, calcium-independent Wnt signaling works primarily through b-catenin. b-Catenin, in turn, can directly activate c-myc and cyclin D1 genes. c-myc and cyclin D1 genes are known to inhibit apoptosis and promote cell proliferation (*Oncogene* 18(55):7860-72). Consistent with this, modest overexpression of b-catenin in a normal epithelial cell (MDCK) results in cellular transformation. These cells form colonies in soft agar, survive in suspension, and continue to proliferate at high cell density and following gamma-irradiation (*J Cell Biol* 146(4):855-68). Thus, inhibition of Wnt signaling could decrease proliferation and increase apoptosis.

5410 may be an important target in BPH. Activation of 5410 will lead to activation of Wnt signaling pathways, which in turn will lead to calcium influx, cell proliferation and anti-apoptosis. Thus, drugs that inhibit 5410 may cause 1) smooth muscle relaxation in BPH prostate; 2) a decrease in prostate cell proliferation; and 3) an increase in prostate cell apoptosis.

Based on the selective and restricted expression of 5410 in the prostate, modulators of 5410 activity would be useful in treating urological disorders, including but not limited to BPH. 5410 polypeptides of the current invention would be useful in screening for modulators of 5410 activity.

Gene ID 30905

The human 30905 sequence, also known as a proton-driven oligopeptide transporter PEPT2 (SEQ ID NO:19), is approximately 2685 nucleotides long including untranslated regions. The coding sequence, located at about nucleic acid 31 to 2220 of SEQ ID NO:19, encodes a 729 amino acid protein (SEQ ID NO:20).

As assessed by TaqMan analysis, 30905 mRNA was expressed in human prostate, central nervous system (CNS), kidney, tonsil and spleen samples. 30905 mRNA was also present in both normal and BPH prostate at high levels. 30905 mRNA was up regulated in two BPH samples.

30905 is the high-affinity, proton-driven oligopeptide transporter PEPT2. Substrates for 30905 include primarily di- and tri-peptides. N-acetyl-L-aspartyl-L-glutamate (NAAG) is a substrate for PEPT2 (*Am J Physiol* 275:C967). NAAG is the most abundant peptide neurotransmitter in the mammalian CNS and can inhibit the N-methyl-d-aspartate (NMDA) subtype of glutamate receptor (*J Neurochem* 75(2):443). NAAG is hydrolyzed by the enzyme N-acetylated a-linked acidic dipeptidase (NAALADase). Interestingly, the prostate-specific membrane antigen (PSMA) possesses hydrolytic activity with the substrate and pharmacological properties of NAALADase, suggesting that NAAG may play an important but unknown role in the prostate (*PNAS* 93:749). NMDA receptors are present in penile, urinary bladder and ventral prostate tissues from adult male rats and homologous surgical tissues from human male patients as measured by Western blots, binding of NMDA receptor antagonist and mRNA. Furthermore, in vitro contraction of tissue strips by bethanechol or electrical field stimulation was inhibited by a variety of NMDA receptor antagonists (*J Androl* 21(4):566). In addition, the NMDA receptor antagonist MK-801 produced a dose-dependent decrease in bladder contraction pressure and urethral activity in normal rats. MK-801 in combination with the AMPA receptor inhibitor LY293558 partially inhibited bladder contraction pressure and markedly depressed urethral contraction concomitant with bladder contraction in chronic spinal rats (*Adv Exp Med Biol* 462:275). Thus, NAAG is likely to be present in the prostate. Because NAAG is an inhibitor of NMDA receptors, inhibition of the uptake of NAAG by inhibiting 30905 could be a novel mechanism for relaxing prostate stromal smooth muscle, thereby relieving symptoms that occur during BPH.

Based on the selective and restricted expression of 30905 in the prostate, modulators of 30905 activity would be useful in treating urological disorders, including but not limited to BPH and urinary incontinence. 30905 polypeptides of the current invention would be useful in screening for modulators of 30905 activity.

Gene ID 2045

The human 2045 sequence, also known as KLK10 (SEQ ID NO:21), is approximately 831 nucleotides long. The coding sequence, located at about nucleic acid 1 to 831 of SEQ ID NO:21, encodes a 276 amino acid protein (SEQ ID NO:22).

As assessed by TaqMan analysis, 2045 mRNA was expressed in the human prostate and in breast, ovary, colon, and prostate tumors. 2045 mRNA was up regulated in BPH. 2045 mRNA also showed higher expression in the prostate epithelia than prostate stroma.

In situ hybridization experiments indicated that 2045 mRNA was present in the prostate epithelia.

2045 is KLK10, a member of the kallikrein family of serine proteases. Kallikrein proteases process kininogens, multifunctional proteins derived mainly from a2-globulin, resulting in the release of kinins, including bradykinin. Bradykinin is known to be a growth factor, causing an increase in cell proliferation. In addition, PSA, a member of the kallikrein family, is known to cleave insulin-like growth factor binding proteins (IGFBP), thus decreasing its affinity for insulin-like growth factor-1 (IGF-1; *World J Urol* 13(5): 306). IGF-1 increases cell proliferation in BPH-derived stromal cells (*J Natl. Cancer Inst.* 91(19):1663). Thus, inhibition of 2045 could result in a decrease of bradykinin and IGF-1 levels in the prostate, and thus would be a novel mechanism for the inhibition of stromal cell growth in BPH.

Based on the selective and restricted expression of 2045 in the prostate, modulators of 2045 activity would be useful in treating urological disorders, including but not limited to BPH. 2045 polypeptides of the current invention would be useful in screening for modulators of 2045 activity.

Gene ID 16405

The human 16405 sequence, also known as G-protein coupled receptor 88 (SEQ ID NO:23), is approximately 2043 nucleotides long including untranslated regions. The coding sequence, located at about nucleic acid 192 to 1346 of SEQ ID NO:23, encodes a 384 amino acid protein (SEQ ID NO:24).

As assessed by TaqMan analysis, 16405 mRNA was expressed in the brain, testes, trigeminal ganglia and skin. 16405 mRNA was up regulated in a sub-population of DRG neurons. In situ hybridization experiments indicated that 16405 mRNA was expressed in the brain, spinal cord, dorsal root ganglion, and sympathetic neurons of the superior cervical ganglion.

16405 is important in the modulation of nociceptive neurons. Based on the selective and restricted expression of 16405 in the brain, modulating the activity of 16405 can alter urinary bladder reflex and/or hyperreflexia and can be a unique target for urinary incontinence. Modulators of 16405 activity would be useful in treating urological disorders, including but not limited to BPH and urinary incontinence. 16405 polypeptides of the current invention would be useful in screening for modulators of 16405 activity.

Gene ID 18560

The human 18560 sequence, also known as vanilloid receptor-like protein 1 (VRL1) or transient receptor potential cation channel, subfamily V, member 2 (TRPV2) (SEQ ID NO:25), is approximately 2809 nucleotides long including untranslated regions. The coding sequence, located at about nucleic acid 361 to 2655 of SEQ ID NO:25, encodes a 764 amino acid protein (SEQ ID NO:26).

As assessed by TaqMan analysis, 18560 mRNA was expressed at highest levels in sympathetic neurons of the superior cervical ganglion (SCG), followed by sensory neurons in the DRG, and trigeminal ganglia (TRG). 18560 mRNA was also expressed in the adrenal gland. 18560 mRNA was expressed at lower levels in spinal cord and brain (whole brain and different brain regions). Some expression of 18560 mRNA was detected in peripheral organs as liver, spleen and thymus.

In situ hybridization experiments showed expression of 18560 mRNA in monkey DRG, Nodose and TRG neurons. High levels of expression were detected in sympathetic neurons. In the spinal cord, 18560 mRNA was expressed in dorsal horn neurons from the superficial laminae and brain.

Based on the selective and restricted expression of 18560 in the DRG and brain, modulating the activity of 18560 can alter urinary bladder reflex and/or hyperreflexia and can be a unique target for urinary incontinence. Modulators of 18560 activity would be useful in treating urological disorders, including but not limited to BPH and urinary incontinence. 18560 polypeptides of the current invention would be useful in screening for modulators of 18560 activity.

Gene ID 2047

The human 2047 sequence, also known as kallikrein 6 (also know as protease M, neurosin, zyme, or SP59) (SEQ ID NO:27), is approximately 1506 nucleotides long including untranslated regions. The coding sequence, located at about nucleic acid 246 to 980 of SEQ ID NO:27, encodes a 244 amino acid protein (SEQ ID NO:28).

As assessed by TaqMan analysis, 2047 mRNA was expressed at very high levels in spinal cord followed by hypothalamus, brain and skin. 2047 mRNA was down regulated in the DRG of rat models after axotomy, chronic constriction injury (CCI) and complete freund's adjuvant (CFA) injection. The most dramatic changes were found in glabrous skin mainly after CFA injection, where 2047 mRNA was up regulated 4 to 10-fold. At late time points after CCI and axotomy, 2047 mRNA was up regulated about 8-fold.

Based on the selective and restricted expression of 2047 in the spinal cord and DRG, modulating the activity of 2047 can alter urinary bladder reflex and/or hyperreflexia and can be a unique target for urinary incontinence. Modulators of 2047 activity would be useful in treating urological disorders, including but not limited to BPH and urinary incontinence. 2047 polypeptides of the current invention would be useful in screening for modulators of 2047 activity.

Gene ID 33751

The human 33751 sequence, also known as potassium voltage-gated channel subfamily H member 7 (Ether-a-go-go related gene potassium channel 3; HERG-3; Eag related protein 3) (SEQ ID NO:29), is approximately 4113 nucleotides long including untranslated regions. The coding sequence, located at about nucleic acid 101 to 3691 of SEQ ID NO:29, encodes a 1196 amino acid protein (SEQ ID NO:30).

As assessed by TaqMan analysis, 33751 mRNA expression levels were highest in the brain followed by the DRG and spinal cord. 33751 mRNA was down regulated in the DRG of rat models after CCI and axotomy. 33751 mRNA was down regulated in the spinal cord of rat models after CFA injection and after axotomy.

In situ hybridization experiments indicated that 33751 mRNA was expressed in monkey and rat brain, spinal cord and DRG. In the monkey spinal cord, 33751 mRNA was expressed in lamina V, in large size neurons, most likely spino-thalamic neurons. In the DRG, a small sub-population of neurons expressed high levels 33751 mRNA.

Based on the selective and restricted expression of 33751 in the DRG, modulating the activity of 33751 can alter urinary bladder reflex and/or hyperreflexia and can be a unique target for urinary incontinence. Modulators of 33751 activity would be useful in treating urological disorders, including but not limited to BPH and urinary incontinence. 33751 polypeptides of the current invention would be useful in screening for modulators of 33751 activity.

Gene ID 52872

The human 52872 sequence, also known as a GPCR GPR54 (SEQ ID NO:31), is approximately 1609 nucleotides long including untranslated regions. The coding sequence, located at about nucleic acid 176 to 1372 of SEQ ID NO:31, encodes a 398 amino acid protein (SEQ ID NO:32).

As assessed by TaqMan analysis, 52872 mRNA expression levels were highest levels in the human brain followed by spinal cord. Expression of 52872 mRNA was also observed in the testis and placenta. 52872 mRNA was expressed at low levels in human DRG, rat brain stem and dorsal nuclei. 52872 mRNA was also up regulated in the DRG of the rat Bladder Outlet Obstruction (BOO) model and in aged SHR.

In situ hybridization experiments confirmed that 52872 mRNA was expressed in the brain cortex, striatum, thalamus, spinal cord, dorsal horn, and in a small sub-population of medium size DRG neurons.

GPCRs are the receptors of different families of neuropeptides. Neuropeptides are involved in inflammation. Neuropeptides like Substance P, produced by bladder afferents, also activate IL-6 and IL-1 expression, both important in inflammation process. C- and A-delta fibers are the sensory bladder afferents.

Based on the selective and restricted expression of 52872 in the brain, spinal cord and DRG, modulating the activity of 52872 can alter urinary bladder reflex and/or hyperreflexia and can be a unique target for urinary incontinence. Modulators of 52872 activity would be useful in treating urological disorders, including but not limited to BPH and urinary incontinence. 52872 polypeptides of the current invention would be useful in screening for modulators of 52872 activity.

Gene ID 14063

The human 14063 sequence, also known as neurotrypsin (or motopsin or leydin) (SEQ ID NO:33), is approximately 3344 nucleotides long including untranslated regions. The coding sequence, located at about nucleic acid 41 to 2668 of SEQ ID NO:33, encodes a 875 amino acid protein (SEQ ID NO:34).

As assessed by TaqMan analysis, 14063 mRNA was expressed at highest levels in lung, DRG, colon, ovary and brain, followed by kidney and spinal cord. 14063 mRNA was up regulated in the DRG of spontaneously hypertensive rats, a model of urinary incontinence.

In situ hybridization experiments indicated that 14063 mRNA was expressed in monkey brain and spinal cord (high levels in motoneurons and neurons in lamina V, with lower levels of expression in dorsal horn). In the DRG, a subpopulation of neurons expressed 14063 mRNA. 14063 mRNA was expressed in the epithelium of bronchi and alveoli, as well as in the epithelium of renal tubules.

Evidence has emerged that extracellular serine proteases are expressed in the developing and adult nervous system tissues. Active substances that are known to directly activate the terminal of C-fibers and A-delta afferents are generated by the catalytic activity of this class of enzymes. C-fibers and A-delta fibers are the sensory bladder afferents. Inhibitors of neurotrypsin will block the generation of active metabolites that induce activation of those neurons that innervate the bladder.

Based on the selective and restricted expression of 14063 in the DRG, modulating the activity of 14063 can alter urinary bladder reflex and/or hyperreflexia and can be a unique target for urinary incontinence. Modulators of 14063 activity would be useful in treating urological disorders, including but not limited to BPH and urinary incontinence. 14063 polypeptides of the current invention would be useful in screening for modulators of 14063 activity.

Gene ID 20739

The human 20739 sequence, also known as serine/threonine protein kinase PAK-beta (PAK-3 kinase) (SEQ ID NO:35), is approximately 1635 nucleotides long. The coding sequence, located at about nucleic acid 1 to 1635 of SEQ ID NO:35, encodes a 544 amino acid protein (SEQ ID NO:36).

As assessed by TaqMan analysis, 20739 mRNA was expressed at highest levels in the brain and spinal cord followed by lower levels of expression in the pancreas and DRG. 20739 mRNA was also up regulated in both female and male rats 24 month L6-S1 and in BOO 8+9 rat models.

In situ hybridization experiments indicated that 20739 mRNA was expressed in monkey and rat brain and spinal cord samples. In monkey and rat DRG, 20739 mRNA expression was restricted to a sub-population of neurons of all sizes.

p21-activated kinase 3 is homologous to Ste20 kinase, a kinase that acts at an early step in the signaling pathway leading from GPCRs to the MAP kinases. Furthermore, PAK3-mediated signaling leads to Jun kinase and p38 mitogen-activated protein kinase activation and regulation of gene transcription. It has been shown that PAK3, via p38 activation induces IL-1 expression. In addition, p38 inhibitors block the sensitization to BK. p38 activation up-regulates the expression of BK-R1 and inducible nitric oxide synthase (iNOS). All these mediators are known to activate directly C-fibers and A-delta afferents and these are the fibers that innervate the bladder. Substance P, a known neuropeptide produced by bladder afferents, also activates p38 resulting in IL-6 and IL-1 expression. Furthermore, PAK-3 itself is up regulated in sensory neurons after inflammation. Inhibition of PAK-3 may block generation of active metabolites.

Based on the selective and restricted expression of 20739 in the brain, spinal cord and DRG, modulating the activity of 20739 can alter urinary bladder reflex and/or hyperreflexia and can be a unique target for urinary incontinence. Modulators of 20739 activity would be useful in treating urological disorders, including but not limited to BPH and urinary incontinence. 20739 polypeptides of the current invention would be useful in screening for modulators of 20739 activity.

Gene ID 32544

The human 32544 sequence, also known as a phospholipase C-delta (PLC-delta) (SEQ ID NO:37), is approximately 4635 nucleotides long including untranslated regions. The coding sequence, located at about nucleic acid 435 to 4058 of SEQ ID NO:37, encodes a 1207 amino acid protein (SEQ ID NO:38).

As assessed by TaqMan analysis, 32544 mRNA was expressed at highest levels in brain followed by spinal cord and skin. Further TaqMan experiments showed high levels of expression of 32544 mRNA in the sympathetic neurons of the superior cervical ganglia. 32544 mRNA was also up regulated in the DRG of rats with spinal cord injury and aged rats. 32544 mRNA was also up regulated in L1-L5 DRG and L6-S1 DRG of cystitis rats.

ISH experiments indicated that 32544 mRNA was expressed in the brain, DRG and spinal cord. In the spinal cord, 33544 mRNA was expressed in the dorsal horn and in the DRG in a small sub-population of neurons.

It has been shown that the activation of PLC-delta isozymes, a member of phosphoinositide-specific phospholipase C family, may occur as an event secondary to the receptor-mediated activation of other PLC isozymes or calcium channels. More recently, it has been also shown that phospholipase C-delta 1 is activated upon bradykinin stimulation. In this situation, it appears that PLC-delta 1 is activated by capacitative calcium entry occurring subsequent to inositol 1,4,5-trisphosphate (IP3) production and calcium release after PLC-beta activation. This regulation of PLC-delta 1 has an important meaning since it may represent a positive feedback mechanism in that the signaling mediated by PLC-beta linked receptors can be potentiated and prolonged. In addition, the activation of PLC-delta 1 after bradykinin stimulation is associated with an increase in intracellular calcium leading to the potentiation of norepinephrine (the main neurotransmitter in sympathetic neurons) secretion. Furthermore, expression of PLC-delta 1 increase in neurons after glutamate treatment. This increase can be prevented by removal of extracellular calcium, NMDA antagonist or nitric oxide (NO) synthase inhibitor.

Phospholipase C-delta 1 appears to be an important mediator in the signaling pathways of agents, like bradykinin, that directly activate C-fibers and A-delta afferents. These are the fibers that innervate the bladder.

Based on the selective and restricted expression of 32544 in the DRG, modulating the activity of 32544 can alter urinary bladder reflex and/or hyperreflexia and can be a unique target for urinary incontinence. Modulators of 32544 activity would be useful in treating urological disorders, including but not limited to BPH and urinary incontinence. 32544 polypeptides of the current invention would be useful in screening for modulators of 32544 activity.

Gene ID 43239

The human 43239 sequence, also known as cysteinyl leukotriene receptor 2 (CysLTR2) (SEQ ID NO:39), is approximately 1041 nucleotides long. The coding sequence, located at about nucleic acid I to 1041 of SEQ ID NO:39, encodes a 346 amino acid protein (SEQ ID NO:40).

As assessed by TaqMan analysis, 43239 mRNA was expressed almost exclusively in monkey DRG. 43239 mRNA was down regulated in DRG in 16 wk and aged SHR. ISH experiments confirmed the high levels of expression of 43239 mRNA in a sub-population of monkey DRG neurons.

Activators of P2Y receptors may produce regulation of inducible nitric oxide synthase, a known agent released during inflammatory processes that change the activity of C-fibers and a-delta afferents that innervate the bladder.

Based on the selective and restricted expression of 43239 in the DRG, modulating the activity of 43239 can alter urinary bladder reflex and/or hyperreflexia and can be a unique target for urinary incontinence. Modulators of 43239 activity would be useful in treating urological disorders, including but not limited to BPH and urinary incontinence. 43239 polypeptides of the current invention would be useful in screening for modulators of 43239 activity.

Gene ID 44373

The human 44373 sequence, also known as zinc transporter ZnT-3 (SEQ ID NO:41), is approximately 2000 nucleotides long including untranslated regions. The coding sequence, located at about nucleic acid 84 to 1250 of SEQ ID NO:41, encodes a 388 amino acid protein (SEQ ID NO:42).

As assessed by TaqMan analysis performed using human and rat tissue panels, 44373 mRNA was mainly expressed in the tissues of nervous system tissues with highest levels of expression seen in the brain followed by the spinal cord. 44373 mRNA was up regulated in the DRG of rats with spinal cord injury and in BOO rat models. 44373 mRNA was down regulated in DRG in 16 wk SHR.

ISH experiments indicated that 44373 mRNA was expressed in the spinal cord and cortex in both monkey and rat samples.

Synaptically released zinc has neuromodulatory capabilities that could result in either inhibition or enhancement of neuronal excitability (*Neurobiol Dis* (1997) 4:137). Zinc is a very potent inhibitor of nitric oxide synthase (*Neurobiol Dis* (1997) 4:137). At physiological concentrations, zinc stimulates the activity of pyridoxal kinase, enhancing the formation of pyridoxal phosphate, which in turn enhances the activity of glutamic acid decarboxylase (*Prog Clin Biol Res* (1984) 144A:255). ZnT-3 is required for the transport of zinc into synaptic vesicles (*PNAS* (1999) 16:1716). Zinc and magnesium are also potent inhibitors of the NMDA receptor complex (*Pol J Pharmacol* (2001) 53:641).

Zinc ions have been shown to modulate glutamate receptors, to enhance the activity of the GABA synthesizing enzyme and to inhibit nitric oxide synthase. All of these modulate the activity of C- and A-delta fibers. These are the fibers that innervate the bladder.

Based on the selective and restricted expression of 44373 in the brain and spinal cord, modulating the activity of 44373 can alter urinary bladder reflex and/or hyperreflexia and can be a unique target for urinary incontinence. Modulators of 44373 activity would be useful in treating urological disorders, including but not limited to BPH and urinary incontinence. 44373 polypeptides of the current invention would be useful in screening for modulators of 44373 activity.

Gene ID 51164

The human 51164 sequence, also known as a potassium channel (SEQ ID NO:43), is approximately 1506 nucleotides long including untranslated regions. The coding sequence, located at about nucleic acid 157 to 1362 of SEQ ID NO:43, encodes a 401 amino acid protein (SEQ ID NO:44).

As assessed by TaqMan analysis, 51164 mRNA was exclusively expressed in monkey DRG. 51164 mRNA was up regulated in the DRG of rats with spinal cord injury. ISH experiments indicated high levels of 51164 mRNA expression in a sub-population of monkey DRG (small and intermediate size) neurons.

51164 is exclusively expressed in DRG. Sensory neurons whose cell bodies are in the thoraco-lumbar and sacral DRG contain substance P (SP) and NOS, mediators which are known to directly activate C-fibers and A-delta afferents. These are the fibers that innervate the bladder. 51164 is important for the modulation of the firing pattern of DRG neurons. Antagonizing 51164 may decrease the firing pattern of these neurons and the release of those mediators that are important during inflammatory processes that activate C-fibers and A-delta afferents.

Based on the selective and restricted expression of 51164 in the DRG, modulating the activity of 51164 can alter urinary bladder reflex and/or hyperreflexia and can be a unique target for urinary incontinence. Modulators of 51164 activity would be useful in treating urological disorders, including but not limited to BPH and urinary incontinence. 51164 polypeptides of the current invention would be useful in screening for modulators of 51164 activity.

Gene ID 53010

The human 53010 sequence, also known as a carboxylesterase (SEQ ID NO:45), is approximately 2158 nucleotides long including untranslated regions. The coding sequence, located at about nucleic acid 96 to 1841 of SEQ ID NO:45, encodes a 581 amino acid protein (SEQ ID NO:46).

As assessed by TaqMan analysis, 53010 mRNA was expressed at very low levels in the brain followed by skin, spinal cord, DRG and liver. The rat orthologue of 53010 was also expressed at very low levels in nervous system tissues. 53010 mRNA was up regulated in the DRG of BOO models.

ISH experiments indicated that 53010 mRNA was expressed in monkey brain and spinal cord. 53010 mRNA was expressed at low levels in human DRG, cortex and a sub-population of thalamic nuclei. Rat ISH experiments showed 53010 mRNA expression in the ventroposterior, ventrolateral and posteroventral nuclei of the thalamus. Low levels of 53010 mRNA expression was observed in the spinal cord.

Carboxylesterases are regulators of the lipid metabolism and enzymes with a broad specificity. They catalyze the reactions of acylglycerol (AG) lipases (that hydrolyzes 2-AG and diacylglycerol (DAG) into arachidonic acid). Carboxylesterases also catalyze amidase reactions (inactivating endogenous cannabinoids) and lysophospholipase reactions (the enzyme that produces lysophosphatidic acid). Carboxylesterase inhibitors have been shown to increase the levels of 2-AG (an endogenous cannabinoid). Inhibition of carboxylesterases will increase the endogenous levels of cannabinoids. Since VR1 and cannabinoid CB1 receptors share ligand recognition properties, cannabinoids can play a role in VR1 receptors inactivating C-fibers and A-delta afferents (where these receptors are located). C- and A-delta fibers are the sensory bladder afferents.

Based on the selective and restricted expression of 53010 in the DRG and brain, modulating the activity of 53010 can alter urinary bladder reflex and/or hyperreflexia and can be a unique target for urinary incontinence. Modulators of 53010 activity would be useful in treating urological disorders, including but not limited to BPH and urinary incontinence. 53010 polypeptides of the current invention would be useful in screening for modulators of 53010 activity.

Gene ID 16852

The human 16852 sequence, also known as large-conductance calcium-activated potassium channel (slowpoke) beta subunit KCNMB4 (SEQ ID NO:47), is approximately 1107 nucleotides long including untranslated regions. The coding sequence, located at about nucleic acid 56 to 688 of SEQ ID NO:47, encodes a 210 amino acid protein (SEQ ID NO:48).

As assessed by TaqMan analysis, 16852 mRNA was exclusively expressed in nervous systems tissues. 16852 mRNA was expressed at highest levels in the brain followed by spinal cord, DRG, placenta and superior cervical ganglion. 16852 mRNA was also up regulated in BOO rats and aged SHR models. ISH experiments confirmed the exclusive expression of 16852 mRNA in the brain, DRG and spinal cord.

16852 is critical for regulating the physiology of neurons, C and A-delta afferents, involved in inflammation pathways. C- and A-delta fibers are the sensory bladder afferents.

Based on the selective and restricted expression of 16852 in the DRG, brain and spinal cord, modulating the activity of 16852 can alter urinary bladder reflex and/or hyperreflexia and can be a unique target for urinary incontinence. Modulators of 16852 activity would be useful in treating urological disorders, including but not limited to BPH and urinary incontinence. 16852 polypeptides of the current invention would be useful in screening for modulators of 16852 activity.

Gene ID 1587

The human 1587 sequence, also known as serine/threonine protein kinase PCTAIRE 3 (SEQ ID NO:49), is approximately 1242 nucleotides long including untranslated regions. The coding sequence, located at about nucleic acid 1 to 1143 of SEQ ID NO:49, encodes a 380 amino acid protein (SEQ ID NO:50).

As assessed by TaqMan analysis, 1587 mRNA was expressed at the highest levels in the spinal cord, brain and diseased heart, followed by lower levels in heart, kidney and DRG. 1587 mRNA was up regulated in the DRG of BOO models and aged SHR.

ISH experiments indicate that 1587 mRNA was expressed in monkey and rat brain, spinal cord and DRG. In the brain and spinal cord, 1587 mRNA was expressed in both neurons and sub-populations of glial cells. In monkey and rat DRG, 1587 mRNA expression was observed in the majority of neurons.

The cell cycle is regulated in central part by ordered action of cyclin-dependent kinase (Cdc/cdk). Some of the Cdk-related kinases have been known to be relatively abundant in neuronal cells that are terminally differentiated. These kinases are thought to play important neural specific function. PCTAIRE 1-3 are members of Cdk-related kinases that are highly expressed in the central nervous system implicating their primary roles in the terminally differentiated neurons. PCTAIRE is a cdc2-related kinase that may be functionally related with cdk5 through ik3-1 an adapter molecule.

Furthermore, one of the cdk5 and cdc2 substrates is amphiphysin, a phosphoprotein that is involved with internalization of GABA receptors through its interaction with dynamin. By blocking the interaction of amphiphysin and dynamin, GABA receptors are maintained in the cell surface, and this results in an increase in the size of inhibitory currents. The Cdk family members may down-regulate GABA receptors by activating amphiphysin and thus the pathway that is responsible for GABA receptor internalization.

Antagonizing 1587 leads to an increase in the levels of the inhibitory amino acid GABA that will block the signal transmission from C-fibers and A-delta afferents by increasing inhibitory pathways. C- and A-delta fibers are the sensory bladder afferents.

Based on the selective and restricted expression of 1587 in the spinal cord, brain and DRG, modulating the activity of 1587 can alter urinary bladder reflex and/or hyperreflexia and can be a unique target for urinary incontinence. Modulators of 1587 activity would be useful in treating urological disorders, including but not limited to BPH and urinary incontinence. 1587 polypeptides of the current invention would be useful in screening for modulators of 1587 activity.

Gene ID 2207

The human 2207 sequence, also known as a rho/rac-interacting citron kinase (SEQ ID NO:5 1), is approximately 6574 nucleotides long including untranslated regions. The coding sequence, located at about nucleic acid 19 to 6180 of SEQ ID NO:51, encodes a 2053 amino acid protein (SEQ ID NO:52).

As assessed by TaqMan analysis, 2207 mRNA was expressed at the highest levels in the brain followed by peripheral blood cells and DRG. 2207 mRNA was expressed at lower levels in the spinal cord. 2207 mRNA was up regulated in the DRG of BOO models and aged SHR.

ISH experiments indicated that 2207 mRNA was expressed in monkey and rat brain, spinal cord and DRG. In the brain, the highest levels of 2207 mRNA expression was seen in the sensory thalamus. In monkey and rat DRG, 2207 mRNA expression was restricted to a sub-population of neurons of all sizes.

Citron kinase is a rho/rac interacting protein expressed mainly in the nervous system. In rat, it has been shown that 2207 forms a heterodimeric complex with NMDA receptors and with PSD95. These complexes have been described in glutamatergic synapses in the hippocampus and in the thalamus. Rho/Rac family of proteins are upstream activators of PAK kinases, COX-2 promoter and other proteins characterized by a novel citron homology domain. It is also known that rho kinase activation inhibits myosin light chain phospbatase that leads to an increase in myosin activity and promotes contractility of the actinomyosin network. Antagonizing 2207 blocks the signal transmission from C-fibers and A-delta afferents by inactivating NMDA receptor activity. C- and A-delta fibers are the sensory bladder afferents.

Based on the selective and restricted expression of 2207 in the DRG, brain and spinal cord, modulating the activity of 2207 can alter urinary bladder reflex and/or hyperreflexia and can be a unique target for urinary incontinence. Modulators of 2207 activity would be useful in treating urological disorders, including but not limited to BPH and urinary incontinence. 2207 polypeptides of the current invention would be useful in screening for modulators of 2207 activity.

Gene ID 22245

The human 22245 sequence, also known as long transient receptor potential channel 2 (LTRPC2) (SEQ ID NO:53), is approximately 6220 nucleotides long including untranslated regions. The coding sequence, located at about nucleic acid 446 to 4957 of SEQ ID NO:53, encodes a 1503 amino acid protein (SEQ ID NO:54).

As assessed by TaqMan analysis performed using human and rat tissue panels, 22245 mRNA was expressed in the nervous system. 22245 mRNA was expressed at highest levels in brain followed by DRG, colon and ovary. 22245 mRNA was down regulated in male 24 month L6-S1 and in 16 wk SHR.

ISH experiments indicated that 22245 mRNA was expressed in brain cortex, hippocampus and in a sub-population of neurons in the DRG, including some small diameter neurons.

Adenosine 5'-diphosphoribose (ADP-ribose) is a ligand for 22245 (*Nature* 2001, 411:595). Activation of metabotropic glutamate receptors in DRG neurons evoked inward $Ca^{++}$-dependent currents. This was mimicked by ADP-ribose precursors (*J Neurophysiol* 1997, 77:2573). Oxidants and $H_2O_2$ can also increase calcium influx via 22245 (*Mol Cell* 2002, 9:163; *JBC* 2002, 277:23150). Calcium influx could also be elicited in cells expressing 22245 by the NO donor S-nitroso-N-acetyl-D,L-penicillamine (SNAP). In addition, arachidonic acid potentiates $Mn^{2+}$ influx in 22245 expressing cells. 22245 plays a critical role in TNFα-mediated cell death (*Mol Cell* 2002, 9:163). TNFα, arachidonic acid and free radicals have been involved in the generation and maintenance of the C- and A-delta fibers responses.

22245 is responsible for non-selective cation conductance permeable to both sodium and calcium. Calcium influx is critical in the activation of C- and A-delta fibers. Furthermore, 22245 can be activated by oxidants and reactive nitrogen species, which have been indicated to be activators of sensory neurons in diabetic neuropathy. Other modulators of C- and A-delta fibers, such as arachidonic acid potentiates 22245 activity. In addition, some of the TNFα activities appear to be mediated by 22245. Therefore, blockers of 22245 would inhibit transmission by C- and A-delta fibers. These fibers are the sensory bladder afferents.

Based on the selective and restricted expression of 22245 in the DRG and brain, modulating the activity of 22245 can alter urinary bladder reflex and/or hyperreflexia and can be a unique target for urinary incontinence. Modulators of 22245 activity would be useful in treating urological disorders, including but not limited to BPH and urinary incontinence. 22245 polypeptides of the current invention would be useful in screening for modulators of 22245 activity.

Gene ID 2387

The human 2387 sequence, also known as glycine receptor alpha 3 subunit (SEQ ID NO:55), is approximately 3069 nucleotides long including untranslated regions. The coding sequence, located at about nucleic acid 421 to 1770 of SEQ ID NO:55, encodes a 449 amino acid protein (SEQ ID NO:56).

As assessed by TaqMan analysis performed using human and rat tissue panels, 2387 mRNA was expressed in the nervous system. 2387 mRNA was expressed at highest levels in the brain followed by spinal cord and DRG. 2387 mRNA was up regulated in the DRG of rat SCI models, in the DRG of rat BOO 8+9 models and the DRG of rat cystitis L6-S1 models. 2387 mRNA was also down regulated in the DRG of rat cystitis L1-L5 and in aged SHR models.

ISH experiments indicated that 2387 mRNA was expressed in a small sub-population of small neurons in the monkey DRG and in the dorsal horn of the monkey spinal cord.

2387 is the glycine receptor alpha 3 subunit. The heterogeneity of the alpha subunits may result in pharmacologically distinct receptors or may represent regional or cellular specific expression. Activation or potentiation of the alpha 3 subunit would inhibit C- and A-delta fibers transmission.

Based on the selective and restricted expression of 2387 in the DRG, brain and spinal cord, modulating the activity of 2387 can alter urinary bladder reflex and/or hyperreflexia and can be a unique target for urinary incontinence. Modulators of 2387 activity would be useful in treating urological disorders, including but not limited to BPH and urinary incontinence. 2387 polypeptides of the current invention would be useful in screening for modulators of 2387 activity.

Gene ID 52908

The human 52908 sequence, also known as potassium voltage-gated channel subfamily H member 6 (also known as Ether-a-go-go related gene potassium channel 2; Eag related protein 2) (SEQ ID NO:57), is approximately 3164 nucleotides long including untranslated regions. The coding sequence, located at about nucleic acid 1 to 2877 of SEQ ID NO:57, encodes a 958 amino acid protein (SEQ ID NO:58).

As assessed by TaqMan analysis, 52908 mRNA was expressed at highest levels in the DRG, followed by the prostate and brain. 52908 mRNA was up regulated in rats with spinal cord injury.

ISH experiments indicated that 52908 mRNA was expressed at low levels in the rat brain. In the spinal cord, 52908 mRNA was expressed in a sub-population of neurons in laminae I, II and V. In addition, some expression of 52908 mRNA was observed around the central canal, lamina X.

Activation of potassium channels affects the frequency and the pattern of neuronal firing. Several voltage-gated potassium channels are expressed in a sub-population of sensory neurons including those involved in bladder innervation (C- and A-delta fibers). Antagonizing 52908 potentially decreases the firing pattern of these neurons and the release of those mediators (substance P and NOS) that are important during inflammatory processes that activate C-fibers and a-delta afferents. These fibers are the sensory bladder afferents.

Based on the selective and restricted expression of 52908 in the DRG, brain and prostate, modulating the activity of 52908 can alter urinary bladder reflex and/or hyperreflexia and can be a unique target for urinary incontinence. Modulators of 52908 activity would be useful in treating urological disorders, including but not limited to BPH and urinary incontinence. 52908 polypeptides of the current invention would be useful in screening for modulators of 52908 activity.

Gene ID 69112

The human 69112 sequence, also known as an orphan serine threonine kinase (SEQ ID NO:59), is approximately 2421 nucleotides long including untranslated regions. The coding sequence, located at about nucleic acid 91 to 2058 of SEQ ID NO:59, encodes a 655 amino acid protein (SEQ ID NO:60).

As assessed by TaqMan analysis, 69112 mRNA was expressed at the highest levels in the DRG and spinal cord, followed by the brain. 69112 mRNA was also up regulated in the DRG of BOO rat models.

ISH experiments showed 69112 mRNA expression in human, monkey and rat brain, spinal cord and DRG. In the brain, 69112 mRNA was expressed at low levels in a sub-population of cortical neurons. In the spinal cord, 69112 mRNA was expressed only in the most superficial laminae, the region involved in nociception. In monkey and rat DRG, 69112 mRNA expression was observed in a very restricted sub-population of neurons, mainly small diameter, nociceptive neurons.

69112 is a new orphan serine threonine kinase with a doublecortin domain and a kinase domain similar to CPG-16 kinase. 69112 is a downstream element of several molecules that are potentially involved in urinary incontinence, i.e. PGE2 that produces bladder hyperactivity; and serotonin that inhibits the micturition reflex.

Based on the selective and restricted expression of 69112 mRNA in the DRG and spinal cord, modulating the activity of 69112 can alter urinary bladder reflex and/or hyperreflexia and can be a unique target for urinary incontinence. Modulators of 69112 activity would be useful in treating urological disorders, including but not limited to BPH and urinary incontinence. 69112 polypeptides of the current invention would be useful in screening for modulators of 69112 activity.

Gene ID 14990

The human 14990 sequence, also known as neurotensin receptor type 2 (NTR2) (SEQ ID NO:61), is approximately 1547 nucleotides long including untranslated regions. The coding sequence, located at about nucleic acid 58 to 1290 of SEQ ID NO:61, encodes a 410 amino acid protein (SEQ ID NO:62).

As assessed by TaqMan analysis, 14990 mRNA was exclusively expressed in brain, spinal cord and at lower levels in the DRG. 14990 mRNA was up regulated in the DRG of BOO 8+9 models.

Neurotensin acts as a neurotransmitter in the central nervous system and as a hormone in the peripheral nervous system. In addition to its role in the regulation of dopamine transmission, it is known that neurotensin has a role in sensory systems like C- and A-delta fibers. These fibers are the sensory bladder afferents. Antagonizing this neurotensin receptor may inhibit C- and A-delta fiber transmission.

Based on the selective and restricted expression of 14990 mRNA in the DRG, modulating the activity of 14990 can alter urinary bladder reflex and/or hyperreflexia and can be a unique target for urinary incontinence. Modulators of 14990 activity would be useful in treating urological disorders, including but not limited to BPH and urinary incontinence. 14990 polypeptides of the current invention would be useful in screening for modulators of 14990 activity.

Gene ID 18547

The human 18547 sequence, also known as vanilloid receptor 1 (SEQ ID NO:63), is approximately 3278 nucleotides long including untranslated regions. The coding sequence, located at about nucleic acid 482 to 3001 of SEQ ID NO:63, encodes a 839 amino acid protein (SEQ ID NO:64).

As assessed by TaqMan analysis, 18547 mRNA was expressed at high levels in the DRG and trigeminal ganglia followed by kidney. 18547 mRNA was also up regulated in the DRG of BOO rats. ISH experiments confirmed a high level of 18547 mRNA in the DRG and TRG and in small diameter neurons. 18547 mRNA was also expressed in the nodose ganglion.

Heat and low pH are known modulators of sensory neurons during inflammation. VR1 knockout mice have severely decreased their responses to chemical and thermal stimuli. VR1 is present in the human urinary bladder and may contribute to distinct pathophysiological states of bladder overactivity, in accord with their differential expression in sensory neurons (C- and A-delta fibers are the sensory bladder afferents).

Modulation of the vanilloid receptor 1 potentially controls bladder overactivity. Based on the selective and restricted expression of 18547 in the DRG, modulating the activity of 18547 can alter urinary bladder reflex and/or hyperreflexia and can be a unique target for urinary incontinence. Modulators of 18547 activity would be useful in treating urological disorders, including but not limited to BPH and urinary incontinence. 18547 polypeptides of the current invention would be useful in screening for modulators of 18547 activity.

Gene ID 115

The human 115 sequence, known also as metabotrophic glutamate receptor 4 (mGluR4) (SEQ ID NO:65), is approximately 3884 nucleotides long including untranslated regions. The coding sequence, located at about nucleic acid 171 to 2909 of SEQ ID NO:65, encodes a 912 amino acid protein (SEQ ID NO:66).

As assessed by TaqMan analysis, 115 mRNA showed restricted expression in the brain, DRG and spinal cord. In rat TaqMan panels, 115 mRNA expression in the DRG is down regulated in SCI models and up regulated in aged SHR rat models.

ISH experiments showed 115 mRNA expression in brain, spinal cord, DRG and bladder samples of human, monkey and rat. In monkey and rat DRG, expression is observed in neurons of all sizes. In human, monkey and rat bladder samples, clear expression of 115 mRNA is seen in urothelium.

115 is the GPCR metabotropic glutamate receptor 4 (mGluR4). The mGLUR family of glutamate receptors provides excitatory and inhibitory controls of synaptic transmission and neuronal excitability in the nervous system. Application of mGluR agonists and antagonists were shown to modulate the nociception response. Nociception neurons are A-delta and C-fiber sensory neurons. The bladder is innervated by A-delta and C-fibers, which play a role in the voiding sensation.

Based on the selective expression and regulation of this ion channel in the DRG in urology animal models, modulating the function of 115 may change the activity of neuronal pathways involved in urinary bladder function, bladder reflex and/or hyperreflexia and may be a unique target for urinary incontinence. Due to 115 expression in the brain and DRG, modulators 115 activity would be useful in treating urological disorders including but not limited to BPH and urinary incontinence. 115 polypeptides of the current invention would be useful in screening for modulators of 115 activity.

Gene ID 579

The human 579 sequence, also known as Orphan sodium- and chloride-dependent neurotransmitter transporter NM3 (SEQ ID NO:67), is approximately 3103 nucleotides long including untranslated regions. The coding sequence, located at about nucleic acid 442 to 2634 of SEQ ID NO:67, encodes a 730 amino acid protein (SEQ ID NO:68).

As assessed by TaqMan analysis, 579 mRNA was exclusively expressed in nervous tissues. 579 mRNA was expressed at the highest levels in the brain followed by spinal cord, DRG, placenta and superior cervical ganglion. 579 mRNA was also up regulated in the DRG of BOO rats and aged SHR models. ISH experiments confirmed the exclusive expression of 579 mRNA in the brain, DRG and spinal cord.

579 is critical for regulating the physiology of neurons, C and A-delta afferents, involved in inflammation pathways. C- and A-delta fibers are the sensory bladder afferents.

Based on the selective and restricted expression of 579 in the DRG, brain and spinal cord, modulating the activity of 579 can alter urinary bladder reflex and/or hyperreflexia and can be a unique target for urinary incontinence. Modulators of 579 activity would be useful in treating urological disorders, including but not limited to BPH and urinary incontinence. 579 polypeptides of the current invention would be useful in screening for modulators of 579 activity.

Gene ID 15985

The human 15985 sequence, known also as a doublecortin-like kinase, (SEQ ID NO:69), is approximately 3552 nucleotides long including untranslated regions. The coding sequence, located at about nucleic acid 208 to 2508 of SEQ ID NO:69, encodes a 766 amino acid protein (SEQ ID NO:70).

As assessed by TaqMan analysis, 15985 mRNA showed restricted expression in nervous tissues. The highest levels of 15985 mRNA expression was observed in the brain and spinal cord followed by the DRG.

In situ hybridization experiments indicated that 15985 mRNA was expressed at the highest levels in the brain, followed by the dorsal horn of the spinal cord, around the central canal and in a sub-population of DRG neurons. In spinal cord and brain, 15985 mRNA expression was observed in both sub-populations of neurons and oligodendrocytes.

15985 is also known as a doublecortin-like kinase. Doublecortin-like kinase is proteolitically cleaved by calpain, a calcium activated protease that is activated after outlet obstruction of the urinary bladder. Calpain activation results in the proteolysis of specific membrane proteins, including those of neuronal membranes resulting in progressive denervation of the detrusor. Furthermore, cyclic AMP-dependent protein kinase PKA, a known modulator of VR1 as well as a possible downstream effector of the 5-HT receptor and prostaglandins, has been shown to phosphorylate CPG-16 a kinase with great homology to 15985. Therefore, increases in intracellular calcium during bladder obstruction injury, results not only in modulation of membrane excitability, but also in activation of intracellular mediators as proteases and kinases. Activation of calpain by calcium cleaves doublecortin kinase yielding an active kinase domain no longer anchored to microtubules. This kinase domain, structurally similar to CPG-16, and now free in the cytoplasm, may be activated by PKA, a known second messenger in neurons innervating the bladder.

Due to 15985 mRNA expression in the brain, spinal cord and DRG, modulators 15985 activity would be useful in treating urological disorders including but not limited to BPH and urinary incontinence. 15985 polypeptides of the current invention would be useful in screening for modulators of 15985. activity.

Gene ID 15625

The human 15625 sequence, known also as purinoceptor 12 (P2Y12) or P2Y12 platelet ADP receptor (SEQ ID NO:71), is approximately 2305 nucleotides long including untranslated regions. The coding sequence, located at about nucleic acid 280 to 1308 of SEQ ID NO:71, encodes a 342 amino acid protein (SEQ ID NO:72).

As assessed by TaqMan analysis, 15625 mRNA showed the highest levels of expression in the brain and spinal cord followed by DRG. In situ hybridization experiments confirmed the high levels of 15625 mRNA expression in the brain, specifically in the glial cells. In addition, very high levels of 15625 mRNA were detected in a sub-population of TRG and DRG neurons. Those neurons expressing 15625 mRNA were the small diameter neurons.

All small diameter sensory neurons in dorsal root ganglia are involved in nociception. Those small neurons located specifically in some lumbar and sacral dorsal root ganglia also innervate the bladder (they are the first step in the detection of bladder sensations). ADP, the ligand for 15625 has been shown to modulate the contractile properties of the bladder muscle. Within the neuronal population in the dorsal root ganglia, 15625, is expressed exclusively and at very high levels in small diameter neurons that may innervate the bladder. This may be a mechanism through which bladder contractility is regulated.

15625 would represent a unique target for urinary incontinence. Modulators of 15625 activity would be useful in treating urological disorders including but not limited to BPH and urinary incontinence. 15625 polypeptides of the current invention would be useful in screening for modulators of 15625 activity.

Gene ID 760

The human 760 sequence, also known as prokineticin receptor 2 (PKR2) (SEQ ID NO:73), is approximately 4052 nucleotides long including untranslated regions. The coding sequence, located at about nucleic acid 45 to 1199 of SEQ ID NO:73, encodes a 384 amino acid protein (SEQ ID NO:74).

As assessed by TaqMan analysis, 760 mRNA expression was observed at the highest levels in brain followed by spinal cord and DRG. Further TaqMan experiments on rat panels indicated that 760 mRNA showed the highest levels of expression in DRG followed by brain and spinal cord.

ISH experiments indicated that 760 mRNA was mainly expressed in the cortex, cingulate and in some thalamic nucleus. In the spinal cord, 760 mRNA was expressed in the most superficial laminae, lamina V and around the central canal, regions involved in visceral sensation and nociception and in motor neurons. In monkey and rat DRG, expression of 760 mRNA was observed in a very restricted sub-population of small diameter neurons.

GPCRs are the receptors for different families of neuropeptides. Neuropeptides are key players in modulating nociceptive and visceral responses. 760 has been recently de-orphaned and its ligands are prokineticin 1 and 2. These are two small proteins that induce contractility of the GI smooth muscle and angiogenesis.

Based on the exquisite and restricted expression of 760 in the peripheral pathways involved bladder innervation, including small diameter sensory neurons in the DRG and their targets within the spinal cord, regulation of the activity of 760 can modulate bladder activity. Modulators of 760 activity would be useful in treating urological disorders, including but not limited to BPH and urinary incontinence. 760 polypeptides of the current invention would be useful in screening for modulators of 760 activity.

Gene ID 18603

The human 18603 sequence, known also as an ankyrin-like protein (ANKTM1) (SEQ ID NO:75), is approximately 3433 nucleotides long including untranslated regions. The coding sequence, located at about nucleic acid 74 to 3433 of SEQ ID NO:75, encodes a 1119 amino acid protein (SEQ ID NO:76).

As assessed by TaqMan analysis on a human tissue panel, elevated expression levels of 18603 mRNA were shown in normal ovary, colon and colon tumor followed by normal bladder and small intestine. 18603 mRNA expression was low in cortex and BPH. (Ovary, Colon>Bladder>>Brain, BPH). Further TaqMan analysis performed on a rat urology panel demonstrated that 18603 mRNA had restricted expression in DRG followed by brain, spinal cord and colon. Subsequent TaqMan analysis on rat urology DRG and bladder panels, demonstrated that 18603 was down regulated in the DRG of SCI rat models and up regulated in the bladder of cystitis rat models.

ISH experiments showed 18603 mRNA expression in monkey and rat DRG samples and in human, monkey and rat bladder samples. In monkey and rat DRG, 18603 mRNA expression is observed in a very restricted sub-population of small diameter neurons. In human, monkey and rat bladder samples, clear expression of 18603 mRNA was seen in urothelium.

18603, which is an ankyrin-like protein (ANKTM1), is a family member of TRPV channels. TRPV channels have been shown to function as temperature sensors as well as mechanoreceptors (*Cell Calcium.* 2003 May; 33 (5-6):479-87 and *Cell Calcium.* 2003 May; 33 (5-6):471-478). ANKTM1 has been shown to be expressed in nociceptive neurons and activated by cold temperatures (*Cell.* 2003 Mar. 21; 112 (6):819-29). Cold and menthol sensitive C afferent fibers were shown to be involved in the bladder cooling reflex test, indicating that cold sensitive receptors play an important role in bladder function (*J. Physiol.* 2002 Aug. 15; 543 (Pt 1):211-20).

Therefore, based on the expression of 18603 in DRG, brain, spinal cord and bladder in urinary incontinent rat models, modulating the activity of this channel may alter urinary bladder reflex and/or hyperreflexia and can be a unique target for urinary incontinence. Modulators of 18603 activity would be useful in treating urological disorders including but not limited to BPH and urinary incontinence. 18603 polypeptides of the present invention would be useful in screening for modulators of 18603 activity.

Gene ID 2395

The human 2395 sequence, known also as melanin-concentrating hormone receptor, GPR24, SLC-1 (SEQ ID NO:77), is approximately 2042 nucleotides long including untranslated regions. The coding sequence, located at about nucleic acid 421 to 1482 of SEQ ID NO:77, encodes a 353 amino acid protein (SEQ ID NO:78).

As assessed by TaqMan analysis performed on a human tissue panel, 2395 mRNA showed restricted expression in brain, DRG, ovary and spinal cord. (Brain>spinal cord, ovary>DRG). Additional TaqMan analyses using rat panels demonstrated that 2395 mRNA had a similar expression pattern as that observed in the human panel and that 2395 mRNA expression in DRG is down regulated in SCI models.

GPCRs are the receptors for different families of neuropeptides. Neuropeptides are key players in modulating sensory responses. 2395 is a G protein-coupled receptor which is also known as GPR24 (SLC-1), somatostatin receptor-like protein and melanin-concentrating hormone (MCH) receptor. MCH, which is an orexigenic peptide, was identified as the endogenous ligand of the SLC-1 receptor.

Therefore, based on the selective and restricted expression of 2395 in the DRG and the down-regulation of 2395 in urinary incontinent rat models (SCI model), modulating the activity of this GPCR may alter urinary bladder reflex and/or hyperreflexia and can be a unique target for urinary incontinence. Modulators of 2395 activity would be useful in treating urological disorders including but not limited to BPH and urinary incontinence. 2395 polypeptides of the present invention would be useful in screening for modulators of 2395 activity.

Gene ID 2554

The human 2554 sequence, also known as metabotrophic glutamate receptor 8a or mGluR8 (SEQ ID NO:79), is approximately 3321 nucleotides long including untranslated regions. The coding sequence, located at about nucleic acid 58 to 2784 of SEQ ID NO:79, encodes a 908 amino acid protein (SEQ ID NO:80).

As assessed by TaqMan analysis performed using a human tissue panel, 2554 mRNA expression was restricted to brain, DRG and spinal cord. (Brain>DRG, spinal cord). Additional TaqMan analyses using rat tissue panels demonstrated that 2554 mRNA was restricted and expressed in brain, spinal cord and DRG and that 2554 mRNA expression in DRG was up regulated in female aged rat models.

2554 is a GPCR within the family of glutamate receptors, namely metabotrophic Glutamate Receptor 8 (mGluR8). This family of glutamate receptors provides excitatory and inhibitory controls of synaptic transmission and neuronal excitability in the nervous system. Application of mGluR agonists and antagonists has been shown to modulate the nociception response. Nociception neurons are A-delta and C-fiber sensory neurons. The bladder is innervated by A-delta and C-fibers, which play a role in voiding sensation. (*J Neurophysiol* 2000 December; 84 (6):2998-3009 and *Pain* 1996 December; 68 (2-3):255-63).

Therefore, based on the selective expression and regulation of 2554 in the DRG of urology animal models, modulating the function of 2554 may change the activity of neuronal pathways involved in urinary bladder function, bladder reflex and/or hyperreflexia and may be a unique target for urinary incontinence. Modulators of 2554 activity would be useful in treating urological disorders including but not limited to BPH and urinary incontinence. 2554 polypeptides of the present invention would be useful in screening for modulators of 2554 activity.

Gene ID 8675

The human 8675 sequence, known also as dihydroxyvitamin D3 24-hydroxylase (SEQ ID NO:81), is approximately 3254 nucleotides long including untranslated regions. The coding sequence, located at about nucleic acid 394 to 1935 of SEQ ID NO:81, encodes a 513 amino acid protein (SEQ ID NO:82).

As assessed by TaqMan analysis on a human tissue panel, elevated expression levels of 8675 mRNA were shown in lung tumor samples, followed by UUI bladder, normal breast and normal tonsil samples. Low expression was additionally observed in kidney and prostate tumor samples (Lung tumor>UUI Bladder>tonsil, breast>>kidney, prostate tumor). Further TaqMan analysis performed on another human tissue panel showed elevated expression of 8675 mRNA in the majority of bladder tissue samples tested. Additional TaqMan analysis performed on a bladder biopsy tissue panel demonstrated that 8675 mRNA expression was up regulated in sensory urge and urge incontinence samples compared to normal tissue samples.

ISH experiments showed 8675 mRNA expression in human, monkey and rat DRG and bladder samples. In monkey and rat DRG, expression was very restricted to a sub-population of small diameter neurons. In human and rat bladders samples, clear expression of 8675 mRNA was seen in urothelium.

8675 is 1,25-dihydroxyvitamin D3 24-hydroxylase and it belongs to the cytochrome P450, family 24, subfamily A. This enzyme biologically inactivates 1,25-dihydroxyvitamin D3 (1,25-(OH)2D3), the physiologically active form of vitamin D3, in the presence of adrenodoxin and NADPH-adrenodoxin reductase. 1,25-(OH)2D3 plays a role in maintaining calcium homeostasis, probably by stimulating Ca-ATPase activity in smooth muscle cells (*J. Cell Biochem.* 2003;88(2):356-62; *Biochem. Biophys. Res. Commun.* 1988 Feb. 15; 150(3):1138-43; *Annu. Rev. Nutr.* 2002; 22:139-66. Epub 2002 Jan. 4; and *J. Mol. Endocrinol.* 2000 October; 25(2): 141-8).

Therefore, based on the specific expression of 8675 in bladder and up-regulation in urinary incontinent samples, modulating the activity of 8675 may lead to smooth muscle relaxation or reduction of bladder smooth muscle tone and may be a unique target to control overactive bladder and urinary incontinence. Modulators of 8675 activity would be useful in treating urological disorders including but not limited to urinary incontinence. 8675 polypeptides of the present invention would be useful in screening for modulators of 8675 activity.

Gene ID 32720

The human 32720 sequence, known also as glucagon-like peptide-2 receptor (GLP-2R) (SEQ ID NO:83), is approximately 1662 nucleotides long. The coding sequence, located at about nucleic acid 1 to 1662 of SEQ ID NO:83, encodes a 553 amino acid protein (SEQ ID NO:84).

As assessed by a TaqMan analysis performed on a human tissue panel, elevated 32720 mRNA expression levels were observed in normal bladder samples, followed by UUI bladder samples and brain cortex samples. Low expression levels were observed in normal pancreas and small intestine samples (Normal bladder>>UUI Bladder, brain cortex>pancreas, intestine). Further TaqMan analysis performed on another human tissue panel showed elevated expression of 32720 mRNA in the majority of bladder tissue samples tested. Additional TaqMan analyses performed on a bladder biopsy tissue panel demonstrated that 32720 mRNA expression was up regulated in sensory urge incontinence samples compared to normal tissue samples.

32720 is a type II GPCR known as glucagon-like peptide-2 receptor (GLP-2R). 32720 is a Gs coupled GPCR and it is a receptor for GLP2. Activation of 32720 would cause an increase in cAMP production. It has been shown that cells that express GLP-2R respond to GLP-2 and increase cAMP production. An increase in cAMP causes smooth muscle relaxation (*Regul. Pept.* 2000 Jun. 30; 90(1-3):27-32 and *Proc. Natl. Acad. Sci. USA.* 1999 Feb. 16; 96(4):1569-73).

Therefore, based on the specific expression of 32720 in bladder and up-regulation in urinary incontinent samples, modulating the activity of 32720 may lead to smooth muscle relaxation or to the reduction of bladder smooth muscle tone. Therefore 32720 may be a unique target to control overactive bladder and urinary incontinence. Modulators of 32720 activity would be useful in treating urological disorders including but not limited to urinary incontinence. 32720 polypeptides of the present invention would be useful in screening for modulators of 32720 activity.

Gene ID 4809

The human 4809 sequence, also known as neuronal nicotinic acetylcholine (ACh) receptor alpha2 subunit (SEQ ID NO:85), is approximately 2664 nucleotides long including untranslated regions. The coding sequence, located at about nucleic acid 555 to 2144 of SEQ ID NO:85, encodes a 529 amino acid protein (SEQ ID NO:86).

As assessed by TaqMan analysis performed using a human tissue panel, 4809 mRNA expression was elevated in prostate tumor samples, followed by BPH prostate samples and brain cortex samples (Prostate tumor>prostate BPH, Cortex). Additional TaqMan analyses using another human tissue panel demonstrated elevated 4809 mRNA expression in normal and BPH prostate samples including peripheral and transitional zone samples.

ISH experiments showed 4809 mRNA expression in human and rat prostate samples as well as monkey and rat brain and DRG samples. Overall, 4809 mRNA signal was positive in the epithelial layer in all BPH and normal human prostates samples. In rat and rabbit prostate, 4809 mRNA expression was lower compared tQ human prostate. ISH was also performed on the beta2 subunit of this gene and showed expression similar to 4809, but with a lesser signal compared to 4809.

4809 is the neuronal nicotinic acetylcholine (ACh) receptor alpha2 subunit, a ligand gated ion channel. Elliot et al. (*J. Mol. Neurosci.* 1996 Fall; 7(3):217-28) showed functional expression using Xenopus oocytes injected with the alpha2 subunit and either of the two non-alpha neuronal nicotinic subunits, beta2 or beta4. In the prostate, it has been shown that activation of acetylcholine receptors by application of activators causes contraction (*J. Auton. Pharmacol.* 1998 August; 18(4):205-11; *Pharmacol. Ther.* 2002 April-May; 94(1-2):93-112 and *Prostate* 1991; 18(4):289-301).

Based on the selective expression and regulation of 4809 in prostate tumor samples and in BPH prostate samples, blocking 4809 with an antagonist would relax smooth muscle cells of the prostate. Such relaxation of prostate smooth muscles would alleviate the symptoms of BPH by reducing the obstruction caused by BPH. Therefore 4809 may be a unique drug target for BPH. Modulators of 4809 activity would be useful in treating urological disorders including but not limited to BPH and urinary incontinence. 4809 polypeptides of the present invention would be useful in screening for modulators of 4809 activity.

Gene ID 14303

The human 14303 sequence (SEQ ID NO:87), known as sodium/hydrogen exchanger 6 (NHE6), is approximately 4452 nucleotides long including untranslated regions. The coding sequence, located at about nucleic acid 36 to 2045 of SEQ ID NO:87, encodes a 669 amino acid protein (SEQ ID NO:88).

As assessed by TaqMan analysis performed using human and rat tissue panels, 14303 mRNA expression levels were highest in CNS tissues. Additionally, 14303 mRNA was shown to be down regulated in spinal cord samples in BOO and cystitis models.

ISH experiments demonstrated that 14303 mRNA was expressed in all neurons of the DRG, spinal cord and cortex. 14303 mRNA was also demonstrated to be expressed in monkey prostate muscle cells.

14303 is a sodium-proton exchanger (NHE), which are thought to be important regulators of pH in and around neurons by pumping protons out of cells following neuronal activity (*J Clin Invest* 104(5):637-45; *J Neurosci Res* 56(4): 358-70; *J Neurosci Res* 1998 Feb. 15; 51(4):431-41). Extracellular acidification has been shown to mediate pain, and protons directly activate VR1 receptors present in nociceptive neurons in the DRG (*J Physiol* 433:145-61; *TIPS* 20:(3):112-8). VR1 receptors are known to be important players in pathways involved in urinary incontinence. Therefore, without being bound by theory, drugs that interact with 14303 may be important for the treatment of urinary incontinence.

Therefore, based on the specific expression of 14303 in CNS specific tissues such as DRG and spinal cord, modulators of 14303 activity would be useful in treating urological disorders including but not limited to urinary incontinence. 14303 polypeptides of the present invention would be useful in screening for modulators of 14303 activity.

Gene ID 16816

The human 16816 sequence (SEQ ID NO:89), phospholipase C delta 4, is approximately 3116 nucleotides long including untranslated regions. The coding sequence, located at about nucleic acid 205 to 2493 of SEQ ID NO:89, encodes a 762 amino acid protein (SEQ ID NO:90).

As assessed by TaqMan analysis using a human tissue panel, 16816 mRNA was expressed at the highest levels in skeletal muscle tissues, followed by bladder tissue samples and tissues of the CNS. Additional TaqMan experiments on a rat tissue panel demonstrated 16816 mRNA expression in skeletal muscle, kidney and CNS tissue samples. Additionally, 16816 mRNA was shown to be down regulated in DRG samples in aged SHR. 16816 mRNA was also shown to be down regulated in spinal cord samples in BOO and cystitis models.

ISH experiments demonstrated that 16816 mRNA was expressed in nociceptive neurons in both monkey and rat DRG samples. 16816 mRNA was also demonstrated to be expressed in monkey brain (thalamus) and muscle tissue samples.

16816 is a phosphatidylinositol-specific phospholipase C (PLC), which plays an important role in receptor-mediated signal transduction by generating two second messenger molecules, inositol 1,4,5-triphosphate (IP3) and diacylglycerol, from phosphatidylinositol 4,5-bisphosphate (PIP2). PLC is well known to be involved in nociceptive pathways. It is well established, for example, that bradykinin and nerve growth factor (NGF), two pro-algesic agents, activate G-protein-coupled (BK2) and tyrosine kinase (TrkA) receptors, respectively, to stimulate phospholipase C (PLC) signaling pathways in primary afferent neurons. It has been shown that bradykinin- or NGF-mediated potentiation of thermal sensitivity in vivo requires expression of VR1, a receptor known to be involved in bladder activity. Diminution of plasma membrane phosphatidylinositol-4,5-bisphosphate (PtdIns(4,5)P2) levels through antibody sequestration or PLC-mediated hydrolysis mimics the potentiating effects of bradykinin or NGF at the cellular level. Moreover, recruitment of PLC-gamma to TrkA is essential for NGF-mediated potentiation of channel activity, and biochemical studies suggest that VR1 associates with this complex (*Nature*. 2001 411(6840):957-62). Given the importance of PLC in nociception and that nociceptive neurons innervate the bladder and play a role in voiding, drugs that interact with 16816 may be important for the treatment of urinary incontinence.

Therefore, based on the specific expression of 16816 in skeletal muscle, bladder and CNS tissues, modulators of 16816 activity would be useful in treating urological disorders including but not limited to urinary incontinence. 16816 polypeptides of the present invention would be useful in screening for modulators of 16816 activity.

Gene ID 17827

The human 17827 sequence (SEQ ID NO:91), Potassium channel subfamily K member 12 KCNK12 (or Tandem pore domain halothane inhibited potassium channel 2 THIK2), is approximately 1943 nucleotides long including untranslated regions. The coding sequence, located at about nucleic acid 466 to 1758 of SEQ ID NO:91, encodes a 430 amino acid protein (SEQ ID NO:92).

As assessed by TaqMan analysis performed using human and rat tissue panels, 17827 mRNA expression levels were highest in central nervous system tissues. Expression of 17827 mRNA was additionally observed in lung, prostate and trachea tissue samples in the rat panel. Additionally, 17827 mRNA was shown to be up regulated in the DRG of SCI models and down regulated in aged SHR models. 17827 mRNA was also shown to be up regulated in spinal cord samples in aged female L6/S1 models and down regulated in cystitis models.

ISH experiments demonstrated that 17827 mRNA was expressed in both monkey and rat DRG neurons of all sizes and in TRG. 17827 mRNA was also demonstrated to be expressed in monkey and rat spinal cord and brain samples 17827 is a potassium channel present in DRG neurons. Activation of K+ channels affect the frequency and the pattern of neuronal firing. Modulation of K+ channels may be important for the firing pattern of nociceptive neurons. Since nociceptive neurons and motor neurons innervate the bladder and play a role in voiding, drugs that interact with 17827 may be important for the treatment of urinary incontinence.

Therefore, based on the selective expression and regulation of 17827 mRNA in CNS tissue samples, modulators of 17827 activity would be useful in treating urological disorders including but not limited to urinary incontinence. 17827 polypeptides of the present invention would be useful in screening for modulators of 17827 activity Gene ID 32620

The human 32620 sequence (SEQ ID NO:93), a sodium-glucose cotransporter KST1 or sodium/myo-inositol cotransporter SMIT2, is approximately 2384 nucleotides long including untranslated regions. The coding sequence, located at about nucleic acid 233 to 2260 of SEQ ID NO:93, encodes a 675 amino acid protein (SEQ ID NO:94).

As assessed by TaqMan analysis performed using human and rat tissue panels, 32620 mRNA expression levels were the highest central nervous system tissues. Expression of 32620 mRNA was additionally observed in colon and small intestine tissue samples in the human panel and in the kidney, prostate and duodenum samples in the rat panel. Additionally, 32620 mRNA was shown to be down regulated in DRG samples of aged SHR models. 32620 mRNA was also shown to be down regulated in spinal cord samples of BOO, cystitis and aged male (L4,L5) models.

ISH experiments demonstrated that 32620 mRNA was mainly expressed in small diameter neurons of the DRG. 32620 mRNA was also shown to be expressed in glial cells of the spinal cord and the cortex of monkey tissues. Low level expression of 32620 mRNA in monkey kidney was also observed.

32620 transports myo-inositol in a sodium-dependent manner. Incorporation of myo-inositol into phosphatidylinositol (PI) was significantly increased in streptozotocin (STZ)-induced diabetic bladder compared to the sucrose-fed and control rat bladders (*Mol Cell Biochem*. 1995 152:71-6). Carbachol (a muscarinic receptor agonist) induced increase in inositol phosphate (IPs) production was higher in the diabetic bladder than in bladders from control and sucrose-fed animals. Enhanced IP production after muscarinic agonist stimulation may be due not only to the up-regulation of muscarinic receptors but also to the increased incorporation of myo-inositol into PI in the STZ-induced diabetic bladder. Diabetes is often associated with urinary incontinence. These data suggest that drugs that interact with 32620 may modulate bladder tone and may be a unique target for urinary incontinence.

Therefore, based on the selective expression and regulation of 32620 in CNS and kidney samples, modulators of 32620 activity would be useful in treating urological disorders including but not limited to urinary incontinence. 32620 polypeptides of the present invention would be useful in screening for modulators of 32620 activity Gene ID 577

The human 577 sequence, also known as sodium-dependent proline transporter SLC6A7 (SEQ ID NO:95), is approximately 1911 nucleotides long. The coding sequence, located at about nucleic acid 1 to 1911 of SEQ ID NO:95, encodes a 636 amino acid protein (SEQ ID NO:96).

As assessed by TaqMan analysis performed using a human tissue panel, 577 mRNA was expressed mainly in brain and in very low levels in the spinal cord. Additional TaqMan analyses using a rat tissue panel demonstrated 577 mRNA expression in brain, spinal cord and DRG. Additionally, 577 mRNA was up regulated in DRG samples in aged SHR.

ISH experiments demonstrated that 577 mRNA was expressed at high levels in monkey and human cortex samples and at low levels in a sub-population of rat DRG neurons. Expression of 577 mRNA was also shown in superficial dorsal horn and intermediate zones of rat spinal cords.

577 is localized in glutamatergic DRG neurons and is blocked by enkephalins. Inhibition of this transporter may mediate some of the enkephalins' analgesic actions. Nociceptive neurons and motor neurons innervate the bladder and play a role in voiding. Drugs that modulate the function of 577 may change the activity of neuronal pathways involved in urinary bladder function, bladder reflex and/or hyperreflexia and may be a unique target for urinary incontinence.

Therefore, based on the selective expression and regulation of 577 in DRG and spinal cord samples, modulators of 577 activity would be useful in treating urological disorders including but not limited to urinary incontinence. 577 polypeptides of the present invention would be useful in screening for modulators of 577 activity.

Gene ID 619

The human 619 sequence, also known as inward rectifier K+ channel Kir3.2 (SEQ ID NO:97), is approximately 2598 nucleotides long including untranslated regions. The coding sequence, located at about nucleic acid 652 to 1923 of SEQ ID NO:97, encodes a 423 amino acid protein (SEQ ID NO:98).

As assessed by TaqMan analysis performed using a human tissue panel, 619 mRNA expression was elevated in brain samples, followed by spinal cord samples. Additional TaqMan analyses using a rat tissue panel demonstrated 619 mRNA expression in CNS specific tissue samples, including DRG. Additionally, 619 mRNA was shown to be up regulated in DRG samples in SCI models and down regulated in DRG samples in aged SHR models. 619 mRNA was also shown to be down regulated in spinal cord samples in BOO and cystitis models and up regulated in spinal cord samples in SHR models.

ISH experiments demonstrated that 619 mRNA was expressed in a sub-population of DRG neurons in monkey and rat samples. Expression of 619 mRNA was also shown in monkey cortex samples and in the dorsal horn of spinal cord samples.

619 is a potassium channel present in DRG neurons. Activation of K+ channels affect the frequency and the pattern of neuronal firing. Modulation of K+ channels may be important for the firing pattern of nociceptive neurons. Nociceptive neurons and motor neurons innervate bladder and play a role in voiding. Drugs that modulate the function of 619 may change the activity of neuronal pathways involved in urinary bladder function, bladder reflex and/or hyperreflexia and may be a unique target for urinary incontinence.

Therefore, based on the selective expression and regulation of 619 in CNS specific tissue samples such as DRG and spinal cord, modulators of 619 activity would be useful in treating urological disorders including but not limited to urinary incontinence. 619 polypeptides of the present invention would be useful in screening for modulators of 619 activity.

Gene ID 1423

The human 1423 sequence, also known as tyrosine-protein kinase receptor Ephrin-B2 (SEQ ID NO:99), is approximately 3924 nucleotides long including untranslated regions. The coding sequence, located at about nucleic acid 1 to 3168 of SEQ ID NO:99, encodes a 1055 amino acid protein (SEQ ID NO:100).

As assessed by TaqMan analysis performed using a human tissue panel, 1423 mRNA expression was elevated in CNS and HUVEC tissue samples and also demonstrated expression in some tumors. Additional TaqMan analyses using a rat tissue panel demonstrated 1423 mRNA expression in CNS and colon tissue samples. 1423 mRNA was also shown to be down regulated in spinal cord samples in BOO and cystitis models.

ISH experiments demonstrated that 1423 mRNA was expressed in a sub-population of DRG neurons in monkey and rat samples. Expression of 1423 mRNA was also shown in monkey and rat spinal cord and cortex samples.

1423 receptors, which are also known as an Ephrin B2 receptor, are localized at excitatory synapses where they cluster and associate with NMDA receptors (*Cell* 2000, 103:945; *Science* 2002, 295:491). More specifically, EphrinB2 activation of EphB receptor potentiates NMDA receptor-dependent influx of calcium (*Science* 2002, 295:491). In addition, treatment of cells with EphrinB2 leads to tyrosine phosphorylation of the NMDA receptor through activation of Src kinases and EphrinB2-dependent events results in enhanced NMDA receptor-dependent gene expression (*Science* 2002, 295:491). Given that NMDA receptor activation plays an important role in nociception in the DRG and that nociceptive neurons innervate the bladder and play a role in voiding, drugs that interact with 1423 may modulate bladder reflex and/or hyperreflexia and may be a unique target for urinary incontinence.

Therefore, based on the selective expression and regulation of 1423 in CNS specific tissue samples such as DRG and spinal cord, modulators of 1423 activity would be useful in treating urological disorders including but not limited to urinary incontinence. 1423 polypeptides of the present invention would be useful in screening for modulators of 1423 activity.

Gene ID 2158

The human 2158 sequence, also known as syntrophin associated serine/threonine kinase (SEQ ID NO:101), is approximately 4833 nucleotides long including untranslated regions. The coding sequence, located at about nucleic acid 40 to 4752 of SEQ ID NO:101, encodes a 1570 amino acid protein (SEQ ID NO:102).

As assessed by TaqMan analysis performed using a human tissue panel, 2158 mRNA expression was elevated in brain and DRG. Additional TaqMan analyses using a rat tissue panel demonstrated 2158 mRNA expression in CNS specific tissue samples. Additionally, 2158 mRNA was shown to be down regulated in DRG samples in aged SHR models and down regulated in spinal cord samples in cystitis models.

ISH experiments demonstrated that 2158 mRNA was expressed in monkey spinal cord and cortex tissue samples and in DRG neurons of all sizes.

2158 interacts with both alpha1 and beta2 synaptotrophin and is thought to link the dystrophin/utrophin network with microtubule filaments via the syntrophins. This gene is important in organizing the postsynaptic machinery necessary for transmission. 2158 is localized in postsynaptic neuronal process and cerebral vasculature and can interact directly with nNOS. Given that nNOS activation plays an important role in nociception in the DRG and that nociceptive neurons and motor neurons innervate the bladder and play a role in voiding, drugs that interact with 2158 may be important for the treatment of urinary incontinence.

Therefore, based on the selective expression and regulation of 2158 in CNS specific tissue samples such as DRG and spinal cord, modulators of 2158 activity would be useful in treating urological disorders including but not limited to urinary incontinence. 2158 polypeptides of the present invention would be useful for modulators of 2158 activity.

Gene ID 8263

The human 8263 sequence, also known as carboxypeptidase-Z (SEQ ID NO:103), is approximately 2100 nucleotides long including untranslated regions. The coding sequence, located at about nucleic acid 40 to 1965 of SEQ ID NO:103, encodes a 641 amino acid protein (SEQ ID NO:104).

As assessed by TaqMan analysis performed using a human tissue panel, 8263 mRNA expression was elevated in ovary tissue samples, followed by CNS, bladder, some tumors and BPH prostate samples. Additional TaqMan analyses using a rat tissue panel demonstrated that 8263 mRNA was widely expressed. Additionally, 8263 mRNA was shown to be down regulated in DRG samples and in spinal cord samples of aged animals. 8263 mRNA was additionally shown to be down regulated in spinal cord samples of aged SHR models and up regulated in spinal cord samples in cystitis models. 8263 mRNA was also shown to be down regulated in bladder samples in SCI models and in aged bladders.

ISH experiments showed 8263 mRNA expression in monkey and rat DRG samples and in human, monkey and rat bladder samples. In monkey and rat DRG, 8263 mRNA expression was observed in neurons of all sizes. In human and monkey bladder samples, expression of 8263 mRNA was mostly seen in urothelium with some expression in muscle. 8263 mRNA was expressed in rat bladder muscle cells and in rat prostate.

8263, carboxypeptidase-Z (CPZ), plays a selective role for CPZ in the processing of extracellular peptides or proteins (*Biochem Biophys Res Commun.* 1999 Mar. 24;256 (3):564-8). Given the important role of peptides such as enkephalin and bradykinin in affecting nociceptive transmission in the DRG, and given that nociceptive neurons innervate the bladder and play a role in voiding, drugs that interact with 8263 may be important for the treatment of urinary incontinence.

Therefore, based on the selective expression and regulation of 8263 in bladder and CNS specific tissue samples such as DRG and spinal cord, modulators of 8263 activity would be useful in treating urological disorders including but not limited to urinary incontinence. 8263 polypeptides of the present invention would be useful in screening for modulators of 8263 activity.

Gene ID 15402

The human 15402 sequence, also known as HNK1 sulfotransferase (SEQ ID NO:105), is approximately 2877 nucleotides long including untranslated regions. The coding sequence, located at about nucleic acid 387 to 1457 of SEQ ID NO:105, encodes a 356 amino-acid protein (SEQ ID NO:106).

As assessed by TaqMan analysis performed using a human tissue panel, 15402 mRNA expression was elevated in CNS samples as well as in ovary, erythroid and HUVEC samples. Additional TaqMan analyses using a rat tissue panel demonstrated 15402 mRNA expression in CNS samples. 15402 mRNA was also shown to be down regulated in spinal cord samples in BOO and cystitis models.

ISH experiments demonstrated that 15402 mRNA was expressed in monkey TRG neurons and in a sub-population of DRG neurons. 15402 mRNA was additionally expressed in human and monkey cortex neuronal populations.

15402 transfers a sulfate to the HNK-1 carbohydrate recognition site present in myelin-associated glycoprotein (MAG; *TINS* 18(4):183-191). Sulfated MAG is a major target for monoclonal IgM in patients with demyelinating neuropathy (*Biochem Biophys Res Commun* 1985 Apr. 16; 128(1):383-8). Given that 15402 may play an important role in nociception in the DRG and that nociceptive neurons innervate the bladder and play a role in voiding, drugs that interact with 15402 may be important for the treatment of urinary incontinence.

Therefore, based on the selective expression and regulation of 15402 mRNA in CNS specific tissue samples such as DRG and spinal cord, modulators of 15402 activity would be useful in treating urological disorders including but not limited to urinary incontinence. 15402 polypeptides of the present invention would be useful in screening for modulators of 15402 activity.

Gene ID 16209

The human 16209 sequence, also known as p56 KKIAMRE protein kinase (SEQ ID NO:107), is approximately 2095 nucleotides long including untranslated regions. The coding sequence, located at about nucleic acid 478 to 1959 of SEQ ID NO:107, encodes a 493 amino acid protein (SEQ ID NO:108).

As assessed by TaqMan analyses performed using human and rat tissue panels, 16209 mRNA expression was elevated in CNS specific samples. 16209 mRNA was also shown to be up regulated in DRG samples in aged female models and in SCI models.

ISH experiments demonstrated that 16209 mRNA was expressed in monkey and rat cortex, spinal cord neurons and DRG neurons of all sizes.

KKIAMRE is suggested to function similarly to MAPK and Ca2+-calmodulin-dependent protein kinase II and play a role in long term potentiation (LTP). LTP occurs via activation of NMDA receptor. Given that NMDA receptor activation plays an important role in nociception in the DRG and that nociceptive neurons and motor neurons innervate the bladder and play a role in voiding, drugs that interact with 16209 may modulate bladder reflex and/or hyperreflexia and may be a unique target for urinary incontinence.

Therefore, based on the selective expression and regulation of 16209 mRNA in CNS specific tissue samples such as DRG and spinal cord, modulators of 16209 activity would be useful in treating urological disorders including but not limited to urinary incontinence. 16209 polypeptides of the present invention would be useful in screening for modulators of 16209 activity.

Gene ID 16386

The human 16386 sequence, also known as brain sulfotransferase-like protein (hBR-STL) (SEQ ID NO:109), is approximately 2419 nucleotides long including untranslated regions. The coding sequence, located at about nucleic acid 21 to 875 of SEQ ID NO:109, encodes a 284 amino acid protein (SEQ ID NO:110).

As assessed by TaqMan analyses performed using human and rat tissue panels, 16386 mRNA expression was elevated in CNS specific samples. 16386 mRNA was also shown to be down regulated in DRG samples of SCI models. 16836 mRNA was additionally shown to be down regulated in spinal cord samples of cystitis models.

ISH experiments demonstrated that 16386 mRNA was expressed in monkey and rat cortex, spinal cord and DRG neurons of all sizes.

There are two major functional classes of sulfotransferases: phenol sulfotransferases and hydroxysteroid sulfotransferases. One major class of phenol sulfotransferases (consisting of SULT1A and SULT1B) are those that sulfate dopamine, tyrosine and thyroid hormones (*Pharmacogenomics Journal* 2002; 2:297-308). 16386 has been shown to sulfate thyroid hormones, suggesting that it is in the dopamine/tyrosine class. Thus 16386 is likely to sulfate dopamine (*Gene* 2002; 285:39-47). Sulfate conjugates of biogenic amines such as dopamine are biologically inactive and are more readily excreted than the amine itself (*Pharmacol Rev.* 1985; 37:333-364). Thus, 16386 may serve to inactivate and remove dopamine from target tissues. Dopamine is known to affect micturition (*Urology.* 2002 59(5 Suppl 1):18-24). Therefore, drugs that interact with 16386 may be important for the treatment of urinary incontinence.

Therefore, based on the selective expression and regulation of 16386 mRNA in CNS specific tissue samples such as DRG and spinal cord, modulators of 16386 activity would be useful in treating urological disorders including but not limited to urinary incontinence. 16386 polypeptides of the present invention would be useful in screening for modulators of 16386 activity.

Gene ID 21165

The human 21165 sequence, also known as beta-1,4-galactosyltransferase 6 (SEQ ID NO:111), is approximately 3931 nucleotides long including untranslated regions. The coding sequence, located at about nucleic acid 298 to 1446 of SEQ ID NO:111, encodes a 382 amino acid protein (SEQ ID NO:112).

As assessed by TaqMan analysis performed using a human tissue panel, 21165 mRNA expression was elevated in CNS and HUVEC samples. Additional TaqMan analyses using a rat tissue panel demonstrated 21165 mRNA expression in CNS, kidney, heart and lung samples. 21165 mRNA was also shown to be down regulated in spinal cord samples of BOO and cystitis models.

ISH experiments demonstrated that 21165 mRNA was expressed in monkey and rat cortex, spinal cord and DRG neurons of all sizes.

D-1-phenyl-2-decanoylamino-3-morpholino-1-propanol (D-PDMP), an inhibitor of 21165 has been shown to inhibit the action of nerve growth factor (NGF) pathways in PC12 cells (*J. Biol. Chem.* 1998 273(40):26001-7). Intravesical application of nerve growth factor acutely induced bladder hyperactivity in Wistar rats (*J Urol.* 2001 March; 165(3): 975-9). Therefore, inhibitors of 21165 may be important for the treatment of urinary incontinence.

Therefore, based on the selective expression and regulation of 21165 in CNS specific tissue samples such as DRG and spinal cord, modulators of 21165 activity would be useful in treating urological disorders including but not limited to urinary incontinence. 21165 polypeptides of the present invention would be useful in screening for modulators of 21165 activity.

Gene ID 30911

The human 30911 sequence, also known as sodium-hydrogen exchanger NHE5 (SEQ ID NO:113), is approximately 3761 nucleotides long including untranslated regions. The coding sequence, located at about nucleic acid 70 to 2760 of SEQ ID NO:113, encodes a 896 amino acid protein (SEQ ID NO:114).

As assessed by TaqMan analyses performed using human and rat tissue panels, 30911 mRNA expression was elevated in CNS specific samples. 30911 mRNA was also shown to be down regulated in spinal cord samples in BOO and cystitis models.

ISH experiments demonstrated that 30911 mRNA was expressed in monkey and rat spinal cord and DRG neurons of all sizes.

Sodium-hydrogen exchangers (NHEs) are thought to be important regulators of pH in and around neurons by pumping protons out of cells following neuronal activity (*J Clin Invest* 104(5):637-45; *J Neurosci Res* 56(4):358-70; *J Neurosci Res* 1998 Feb. 15; 51(4):431-41). Extracellular acidification has been shown to mediate pain, and protons directly activate VR1 receptors present in nociceptive neurons in the DRG (*J Physiol* 433:145-61; *TIPS* 20:(3):112-8). VR1 receptors are important players in pathways involved in urinary incontinence. Therefore, drugs that interact with 30911 may be important for the treatment of urinary incontinence.

Therefore, based on the selective expression and regulation of 30911 in CNS specific tissue samples such as DRG and spinal cord, modulators of 30911 activity would be useful in treating urological disorders including but not limited to urinary incontinence. 30911 polypeptides of the present invention would be useful in screening for modulators of 30911 activity.

Gene ID 41897

The human 41897 sequence, also known as heparan sulfate D-glucosaminyl 3-O-sulfotransferase-2 (SEQ ID NO:115), is approximately 1968 nucleotides long including untranslated regions. The coding sequence, located at about nucleic acid 73 to 1176 of SEQ ID NO:115, encodes a 367 amino acid protein (SEQ ID NO:116).

As assessed by TaqMan analysis performed using a human tissue panel, 41897 mRNA expression was elevated in CNS samples and was also shown to be expressed in macrophages. Additional TaqMan analyses using a rat tissue panel demonstrated 41897 mRNA expression in CNS samples. 41897 mRNA was also shown to be down regulated in DRG in SCI models. 41897 mRNA was also down regulated in spinal cord samples in cystitis models.

ISH experiments demonstrated that 41897 mRNA was expressed in monkey and rat cortex, spinal cord and DRG neurons of all sizes.

TNF-alpha increases the expression of glycosyltransferases and sulfotransferase. (*JBC* 2002 277:424-431). TNF-alpha mRNA expression levels were increased (2 to 10-fold) after acute cystitis (*Physiol Genomics.* 2002; 9:5-13), a disease often associated with urinary incontinence. In addition, sulfotransferases are also responsible for the catabolism of monoamines such as dopamine (*Mol Pharm* 1998 Dec; 54(6):942-8). Dopamine is known to affect micturition (*Urology.* 2002 59(5 Suppl 1): 18-24). Therefore drugs that interact with 41897 may be important for the treatment of urinary incontinence.

Therefore, based on the selective expression and regulation of 41897 in CNS specific tissue samples such as DRG and spinal cord, modulators of 41897 activity would be useful in treating urological disorders including but not limited to urinary incontinence. 41897 polypeptides of the present invention would be useful in screening for modulators of 41897 activity.

Gene ID 1643

The human 1643 sequence (SEQ ID NO:117), also known as nimA-related protein kinase 3 (NEK3), is approximately 2104 nucleotides long including untranslated regions. The coding sequence, located at about nucleic acid 96 to 1616 of SEQ ID NO:117, encodes a 506 amino acid protein (SEQ ID NO:118).

As assessed by TaqMan analysis performed using human and rat tissue panels, 1643 mRNA expression levels were highest in tissues of the CNS. Additionally, 1643 mRNA was expressed in human colon tumor samples and in rat testes, lung, spleen, duodenum and colon samples. 1643 mRNA was shown to be up regulated in DRG samples in SCI models and down regulated in SHR models. 1643 mRNA was additionally shown to be down regulated in spinal cord samples in BOO and aged SHR models.

ISH experiments demonstrated that 1643 mRNA was expressed in a sub-population of rat DRG neurons including small diameter neurons.

1643 is expressed in neurons of the DRG. Nociceptive neurons and motor neurons innervate bladder and play a role in voiding. Drugs that modulate the function of 1643 may change the activity of neuronal pathways involved in urinary bladder function, bladder reflex and/or hyperreflexia and may be a unique target for urinary incontinence.

Therefore, based on the specific expression and regulation of 1643 in CNS specific tissues such as DRG and spinal cord, modulators of 1643 activity would be useful in treating urological disorders including but not limited to urinary incontinence. 1643 polypeptides of the present invention would be useful in screening for modulators of 1643 activity.

Gene ID 2543

The human 2543 sequence (SEQ ID NO:119), also known as corticotropin-releasing factor receptor 2 (CRF2), is approximately 2110 nucleotides long including untranslated regions. The coding sequence, located at about nucleic acid 1 to 1236 of SEQ ID NO:119, encodes a 411 amino acid protein (SEQ ID NO:120).

As assessed by TaqMan analysis using a human tissue panel, 2543 mRNA expression was elevated in pituitary gland and brain samples. Additionally, very low 2543 mRNA expression levels were observed in pancreas and heart samples. Additional TaqMan experiments on a rat tissue panel demonstrated restricted expression in brain, spinal cord, DRG and bladder samples. An additional TaqMan experiment using another rat tissue panel showed that 2543 mRNA expression in DRG was down regulated in a SHR model.

ISH experiments showed 2543 mRNA expression in monkey and rat brain, DRG and bladder samples. In monkey and rat DRG, expression was observed in neurons of all sizes. In monkey and rat bladders samples, 2543 mRNA was expressed in urothelium cells.

2543 is a GPCR, namely corticotropin-releasing factor receptor 2 (CRF2). 2543 has a high-affinity for binding CRF and it also binds to urocortin I, II and III. Binding of ligand to this GPCR results in stimulation of adenylate cyclase activity and activates neurons. Based on the selective and restricted expression of 2543 in the DRG and down-regulation in a urinary incontinent rat model (SHR model), modulating the activity of this GPCR can alter urinary bladder reflex and/or hyperreflexia and can be a unique target for urinary incontinence Therefore, based on the specific expression of 2543 in brain, DRG and bladder tissues, modulators of 2543 activity would be useful in treating urological disorders including but not limited to urinary incontinence. 2543 polypeptides of the present invention would be useful in screening for modulators of 2543 activity.

Gene ID 9626

The human 9626 sequence (SEQ ID NO:121), also known as amiloride-sensitive ion channel ASIC2 (also known as MDEG and BNaC1), is approximately 1663 nucleotides long including untranslated regions. The coding sequence, located at about nucleic acid 128 to 1663 of SEQ ID NO:121, encodes a 512 amino acid protein (SEQ ID NO:122).

As assessed by TaqMan analysis performed using human and rat tissue panels, 9626 mRNA expression levels were highest in tissues of the CNS. Expression of 9626 mRNA was additionally observed in human peripheral blood mononuclear and uninfected leukocyte cells and in rat testes. Additionally, 9626 mRNA was shown to be down regulated in DRG samples of SCI and aged male L4,5 DRG models. 9626 mRNA was also shown to be down regulated in spinal cord samples of cystitis models.

ISH experiments demonstrated that 9626 mRNA was expressed in a sub-population of mainly small diameter neurons in rat and monkey DRG.

Amiloride-sensitive ion channels (ASICs) are acid-sensing channels. Previous studies have demonstrated that ASICs are present in sensory neurons of the DRG and some subtypes have been shown to participate in nociception. Furthermore, extracellular acidification has been shown to mediate pain, and protons directly activate VR1 receptors present in nociceptive neurons in the DRG (*J Physiol* 433:145-61; *TIPS* 20:(3): 112-8). VR1 receptors are important players in pathways involved in urinary incontinence. Since nociceptive neurons and motor neurons innervate the bladder and play a role in voiding, and since ASICs could potentially interact with VR1, drugs which interact with 9626 may be important for the treatment of urinary incontinence.

Therefore, based on the selective expression and regulation of 9626 in CNS samples, modulators of 9626 activity would be useful in treating urological disorders including but not limited to urinary incontinence. 9626 polypeptides of the present invention would be useful in screening for modulators of 9626 activity Gene ID 13231

The human 13231 sequence (SEQ ID NO:123), also known as nima-related protein kinase 1 (NEK1), is approximately 3645 nucleotides long. The coding sequence, located at about nucleic acid 1 to 3645 of SEQ ID NO:123, encodes a 1214 amino acid protein (SEQ ID NO:124).

As assessed by TaqMan analysis performed using human and rat tissue panels, 13231 mRNA expression levels were highest in tissues of the CNS. Expression of 13231 mRNA was additionally observed in DRG and erythroids in the human panel and in the testes in the rat panel. Additionally, 13231 mRNA was shown to be down regulated in spinal cord samples of BOO models and up regulated in spinal cord samples of cystitis models.

ISH experiments demonstrated that 13231 mRNA was mainly expressed in a sub-population of rat and monkey DRG neurons including small diameter neurons.

13231 is expressed in neurons of the DRG. Nociceptive neurons and motor neurons innervate bladder and play a role in voiding. Drugs that modulate the function of 13231 may change the activity of neuronal pathways involved in urinary bladder function, bladder reflex and/or hyperreflexia and may be a unique target for urinary incontinence.

Therefore, based on the selective expression and regulation of 13231 in CNS and DRG samples, modulators of 13231 activity would be useful in treating urological disorders including but not limited to urinary incontinence. 13231 polypeptides of the present invention would be useful in screening for modulators of 13231 activity Gene ID 32409

The human 32409 sequence, also known as serine protease DESC1 (SEQ ID NO:125), is approximately 1471 nucleotides long including untranslated regions. The coding sequence, located at about nucleic acid 53 to 1324 of SEQ ID NO:125, encodes a 423 amino acid protein (SEQ ID NO:126).

As assessed by TaqMan analysis performed using a human tissue panel, 32409 mRNA was expressed mainly in lung tumor, normal bladder and UUI bladder samples. Further TaqMan analyses using a rat tissue panel demonstrated 32409 mRNA expression in brain, spinal cord, DRG and bladder samples. Additionally, 32409 mRNA was shown to be down regulated in bladder samples in a cystitis rat model.

ISH experiments showed 32409 mRNA expression in monkey and rat DRG and bladder samples. In monkey and rat DRG, expression was observed in neurons of all sizes. In monkey and rat bladder samples, 32409 mRNA was expressed in urothelium and smooth muscle cells.

32409 is serine protease DESC1 and belongs to the peptidase family S1. Peptidases are a family of genes that break down various peptides that play a role in multiple physiological functions. Based on the selective and restricted expression of this enzyme in bladder and its down-regulation in an urinary incontinent rat model (cystitis model), modulating the activity of 32409 may lead to smooth muscle relaxation or reduction of bladder smooth muscle tone and may be a unique target to control overactive bladder and urinary incontinence.

Therefore, based on the selective expression and regulation of 32409 in bladder samples, modulators of 32409 activity would be useful in treating urological disorders including but not limited to urinary incontinence. 32409 polypeptides of the present invention would be useful in screening for modulators of 32409 activity.

Gene ID 84260

The human 84260 sequence, also known as carboxypeptidase A6 (SEQ ID NO:127), is approximately 1907 nucleotides long including untranslated regions. The coding sequence, located at about nucleic acid 217 to 1530 of SEQ ID NO:127, encodes a 437 amino acid protein (SEQ ID NO:128).

As assessed by TaqMan analysis performed using a human tissue panel, 84260 mRNA expression was very restricted to prostate and colon tumor followed by BPH prostate (Prostate tumor, colon tumor>BPH prostate). Further TaqMan analyses using another human tissue panel demonstrated up-regulation of 84260 mRNA in BPH samples compared to normal prostate samples. An additional TaqMan analysis using a prostate epithelium vs. prostate stroma panel demonstrated expression in both epithelium and stromal components of the prostate.

ISH experiments demonstrated that 84260 mRNA was expressed in the basal epithelial layer of human BPH prostate samples. No expression was seen in normal prostate samples.

84260 is carboxypeptidase A6, which has about 40% identity with carboxypeptidase B and belongs to the family of carboxypeptidase A. Carboxypeptidases have been shown to play a role in cell proliferation. Based on the selective expression and up-regulation of 84260 in BPH, blocking the activity of 84260 with antagonists may cause stromal, or epithelial cell apoptosis in prostate samples and therefore may be useful in reducing the symptoms of BPH.

Therefore, based on the selective expression and regulation of 84260 in prostate tissue samples, modulators of 84260 activity would be useful in treating urological disorders including but not limited to BPH. 84260 polypeptides of the present invention would be useful in screening for modulators of 84260 activity.

Gene ID 2882

The human 2882 sequence (SEQ ID NO:129), known also as G protein-coupled receptor 26 (GPR26), is approximately 2530 nucleotides long including untranslated regions. The coding sequence, located at about nucleic acid 186 to 1199 of SEQ ID NO:129, encodes a 337 amino acid protein (SEQ ID NO:130).

As assessed by TaqMan analysis, 2882 mRNA was highly expressed in human CNS tissues, with low levels of expression in artery. 2882 mRNA was also highly expressed in rat CNS tissues. In a urology panel, 2882 mRNA was expressed in the DRG and was down regulated in BOO and cystitis models.

ISH showed rat 2882 mRNA was expressed in several regions of the brain including cortical neurons, striatal neurons, amygdala neurons, entorhinal cortical neurons, cerebellar purkinje cells, and hippocampal neurons in the CA1, CA3 and dentate gyrus regions. Monkey 2882 mRNA was expressed in several regions of the brain including substantia nigra neurons, thalamic neurons and cortical neurons.

2882 is present in neurons of the DRG and is regulated in multiple models relevant to urology. Nociceptive neurons and motor neurons of the DRG innervate the bladder and play a role in voiding. Therefore, drugs that interact with 2882 may modulate bladder reflex and/or hyperreflexia and may be a unique target for urinary incontinence.

Therefore, based on the specific expression and regulation of 2882 in CNS specific tissues such as the DRG and in models of urological disease, modulators of 2882 activity would be useful in treating urological disorders including but not limited to urinary incontinence. 2882 polypeptides of the present invention would be useful in screening for modulators of 2882 activity.

Gene ID 8203

The human 8203 sequence (SEQ ID NO:131), known also as histamine H3 receptor, is approximately 2699 nucleotides long including untranslated regions. The coding sequence, located at about nucleic acid 299 to 1636 of SEQ ID NO:131, encodes a 445 amino acid protein (SEQ ID NO:132).

As assessed by TaqMan analysis using a human tissue panel, 8203 mRNA expression levels were highest in CNS tissues and was also present in peripheral blood mononuclear cells (PBMC) at low levels. In a rat tissue panel, 8203 mRNA expression levels were highest in CNS tissues and was also present in aorta at low levels. In a urology panel, 8203 mRNA expression was down regulated in the spinal cord of cystitis models and in the bladder of SCI models.

ISH experiments on rat tissues showed 8203 mRNA is expressed in a sub-population of small DRG neurons, superior cervical ganglion neurons, thalamic neurons and cerebellar Purkinje cells.

Histamine contracts urothelium in bladder (*J of Urology.* February 2002; 167(2, Part 1 of 2):742-745) and intact arterial smooth muscle. Histamine induces antinociception when administered directly into the rodent CNS. Furthermore, histamine stimulates various peripheral nerve endings. Activation of $H_3$ receptors on C-fibers sensory endings inhibit the release of substance P and neurokinin, neuropeptides involved in nociceptive behavior. Histamine $H_3$ receptor agonist, (R)α-MeHA, displayed anti-inflammatory and anti-nociceptive properties in rodents. Nociceptive neurons and motor neurons of the DRG innervate the bladder and play a role in voiding. Therefore, drugs which interact with histamine receptors, including 8203, may modulate bladder reflex and/or hyperreflexia and may be a unique target for urinary incontinence Therefore, based on the specific expression and regulation of 8203 in CNS tissues and models of urological disease, modulators of 8203 activity would be useful in treating urological disorders including but not limited to urinary incontinence. 8203 polypeptides of the present invention would be useful in screening for modulators of 8203 activity.

Gene ID 32678

The human 32678 sequence (SEQ ID NO:133), known also as amiloride-sensitive brain sodium channel BNaC2, (or ASIC1; ACCN2), is approximately 3923 nucleotides long including untranslated regions. The coding sequence, located at about nucleic acid 230 to 1954 of SEQ ID NO:133, encodes a 574 amino acid protein (SEQ ID NO:134).

As assessed by TaqMan analysis using a human tissue panel, 32678 mRNA expression levels were highest in CNS tissues. It was also present in colon tumor and PBMC. In a rat tissue panel, 32678 mRNA expression levels were highest in DRG, cortex, and spinal cord. In a urology panel, 32678 mRNA was down regulated in the cystitis and SCI models.

Amiloride-sensitive ion channels (ASICs) are acid-sensing channels. Previous studies have demonstrated that ASICs are present in sensory neurons of the DRG and some subtypes have been shown to participate in nociception. Furthermore, extracellular acidification has been shown to mediate pain, and protons directly activate VR-1 receptors present in nociceptive neurons in the DRG (*J. Physiol.*; 433:145-61; *TIPS;* 20(3):112-8). VR1 receptors are important players in pathways involved in urinary incontinence. Since nociceptive neurons and motor neurons innervate the bladder and play a role in voiding and since ASICs could potentially interact with VR1, drugs that interact with 32678 may be important for the treatment of urinary incontinence.

Therefore, based on the specific expression and regulation of 32678 in CNS tissues and urological models of disease, modulators of 32678 activity would be useful in treating urological disorders including but not limited to urinary incontinence. 32678 polypeptides of the present invention would be useful in screening for modulators of 32678 activity.

Gene ID 55053

The human 55053 sequence (SEQ ID NO:135), a serine/threonine protein kinase, is approximately 2980 nucleotides long including untranslated regions. The coding sequence, located at about nucleic acid 86 to 2422 of SEQ ID NO:135, encodes a 778 amino acid protein (SEQ ID NO:136).

As assessed by TaqMan analysis using a human tissue panel, 55053 mRNA expression levels were highest in CNS tissues. In a rat tissue panel, 55053 mRNA expression levels were also highest in CNS tissues. In a urology panel, 55053 mRNA was down regulated in the cystitis model.

ISH experiments on rat tissues showed 55053 mRNA was expressed in most DRG neurons. In human tissues, 55053 mRNA was expressed in cortical and spinal cord neurons. In monkey tissues, 55053 mRNA was expressed in most DRG neurons, as well as in neurons in the spinal cord and cortex.

55053 is a kinase present in neurons of the DRG and is regulated in the cystitis model relevant to urology. Nociceptive neurons and motor neurons of the DRG innervate the bladder and play a role in voiding. Therefore, drugs that interact with 55053 may modulate bladder reflex and/or hyperreflexia and may be a unique target for urinary incontinence.

Therefore, based on the selective expression and regulation of 55053 in DRG and urological models of disease, modulators of 55053 activity would be useful in treating urological disorders including but not limited to urinary incontinence. 55053 polypeptides of the present invention would be useful in screening for modulators of 55053 activity.

Various aspects of the invention are described in further detail in the following subsections:

Screening Assays

The invention provides a method (also referred to herein as a "screening assay") for identifying modulators, i.e., candidate or test compounds or agents (e.g., peptides, peptidomimetics, small molecules (organic or inorganic) or other drugs) which bind to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins, have a stimulatory or inhibitory effect on, for example, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity, or have a stimulatory or inhibitory effect on, for example, the expression or activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate. Compounds identified using the assays described herein may be useful for treating a urological disorder.

43

These assays are designed to identify compounds that bind to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, bind to other intracellular or extracellular proteins that interact with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, and interfere with the interaction of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein with other intercellular or extracellular proteins. For example, in the case of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, which is a transmembrane receptor-type protein, such techniques can identify ligands for such a receptor. A 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein ligand or substrate can, for example, be used to ameliorate at least one symptom of a urological disorder. Such compounds may include, but are not limited to peptides, antibodies, or small organic or inorganic compounds. Such compounds may also include other cellular proteins.

Compounds identified via assays such as those described herein may be useful, for example, for treating a urological disorder. In instances whereby a urological disorder condition results from an overall lower level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression and/or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein in a cell or tissue that interact with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein may include compounds which accentuate or amplify the activity of the bound 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Such compounds would bring about an effective increase in the level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein activity, thus ameliorating symptoms.

In other instances, mutations within the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene may cause aberrant types or excessive amounts of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins to be made which have a deleterious effect that leads to a urological disorder. Similarly, physiological conditions may cause an excessive increase in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression leading to a urological disorder. In such cases, compounds that bind to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein may be identified that inhibit the activity of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Assays for testing the effectiveness of compounds identified by techniques such as those described in this section are discussed herein.

In one embodiment, the invention provides assays for screening candidate or test compounds which are substrates of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or polypeptide or biologically active portion thereof. In another embodiment, the invention provides assays for screening candidate or test compounds which bind to or modulate the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or polypeptide or biologically active portion thereof. The test compounds of the present invention can be obtained using any of the numerous approaches in combinatorial library methods known in the art, including: biological libraries; spatially addressable parallel solid phase or solution phase libraries; synthetic library methods requiring deconvolution; the 'one-bead one-compound' library method; and synthetic library methods using affinity chromatography selection. The biological library approach is limited to peptide libraries, while the other four approaches are applicable to peptide, non-peptide oligomer or small molecule libraries of compounds (Lam, K. S. (1997) Anticancer Drug Des. 12:145).

Examples of methods for the synthesis of molecular libraries can be found in the art, for example in: DeWitt et al. (1993) Proc. Natl. Acad. Sci. U.S.A. 90:6909; Erb et al. (1994) Proc. Natl. Acad. Sci. USA 91:11422; Zuckermann et al. (1994). J. Med. Chem. 37:2678; Cho et al. (1993) Science 261:1303; Carrell et al. (1994) Angew. Chem. Int. Ed. Engl. 33:2059; Carell et al. (1994) Angew. Chem. Int. Ed. Engl. 33:2061; and in Gallop et al. (1994) J. Med. Chem. 37:1233.

Libraries of compounds may be presented in solution (e.g., Houghten (1992) Biotechniques 13:412-421), or on beads (Lam (1991) Nature 354:82-84), chips (Fodor (1993) Nature 364:555-556), bacteria (Ladner U.S. Pat. No. 5,223, 409), spores (Ladner USP '409), plasmids (Cull et al. (1992) Proc Natl Acad Sci USA 89:1865-1869) or on phage (Scott and Smith (1990) Science 249:386-390); (Devlin (1990) Science 249:404-406); (Cwirla et al. (1990) Proc. Natl. Acad. Sci. 87:6378-6382); (Felici (1991) J. Mol. Biol. 222: 301-310); (Ladner supra.).

In one embodiment, an assay is a cell-based assay in which a cell which expresses a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or biologically active portion thereof is contacted with a test compound and the ability of the test compound to modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is determined. Determining the ability of the test compound to modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity can be accomplished by monitoring, for example, intracellular calcium, $IP_3$, cAMP, or diacylglycerol concentration, the phosphorylation profile of intracellular proteins, cell proliferation and/or migration, gene expression of, for example, cell surface adhesion molecules or genes associated with UI and/r BPH, or the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-regulated transcription factor. The cell can be of mammalian origin, e.g., a neural cell. In one embodiment, compounds that interact with a receptor domain can be screened for their ability to function as ligands, i.e., to bind to the receptor and modulate a signal transduction pathway. Identification of ligands, and measuring the activity of the ligand-receptor complex, leads to the identification of modulators (e.g., antagonists) of this interaction. Such modulators may be useful in the treatment of a urological disorder.

The ability of the test compound to modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 binding to a substrate or to bind to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can also be determined. Determining the ability of the test compound to modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 binding to a substrate can be accomplished, for example, by coupling the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate with a radioisotope or enzymatic label such that binding of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be determined by detecting the labeled 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate in a complex. 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 could also be coupled with a radioisotope or enzymatic label to monitor the ability of a test compound to modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 binding to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate in a complex. Determining the ability of the test compound to bind 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be accomplished, for example, by coupling the compound with a radioisotope or enzymatic label such that binding of the compound to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be determined by detecting the labeled 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 compound in a complex. For example, compounds (e.g., 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 ligands or substrates) can be labeled with $^{125}I$, $^{35}S$, $^{14}C$, or $^{3}H$, either directly or indirectly, and the radioisotope detected by direct counting of radioemmission or by scintillation counting. Compounds can further be enzymatically labeled with, for example, horseradish peroxidase, alkaline phosphatase, or luciferase, and the enzymatic label detected by determination of conversion of an appropriate substrate to product.

It is also within the scope of this invention to determine the ability of a compound (e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 ligand or substrate) to interact with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 without the labeling of any of the interactants. For example, a microphysiometer can be used to detect the interaction of a compound with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 without the labeling of either the compound or the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 (McConnell, H. M. et al. (1992) *Science* 257:1906-1912. As used herein, a "microphysiometer" (e.g., Cytosensor) is an analytical instrument that measures the rate at which a cell acidifies its environment using a light-addressable potentiometric sensor (LAPS). Changes in this acidification rate can be used as an indicator of the interaction between a compound and 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053.

In another embodiment, an assay is a cell-based assay comprising contacting a cell expressing a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule (e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate) with a test compound and determining the ability of the test compound to modulate (e.g., stimulate or inhibit) the activity of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule. Determining the ability of the test compound to modulate the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule can be accomplished, for example, by determining the ability of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to bind to or interact with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule.

Determining the ability of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or a biologically active fragment thereof, to bind to or interact with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule can be accomplished by one of the methods described above for determining direct binding. In a preferred embodiment, determining the ability of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to bind to or interact with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule can be accomplished by determining the activity of the target molecule. For example, the activity of the target molecule can be determined by detecting induction of a cellular second messenger of the target (i.e., intracellular $Ca^{2+}$, diacylglycerol, $IP_3$, cAMP), detecting catalytic/enzymatic activity of the target on an appropriate substrate, detecting the induction of a reporter gene (comprising a target-responsive regulatory element operatively linked to a nucleic acid encoding a detectable marker, e.g., luciferase), or detecting a target-regulated cellular response (e.g., gene expression).

In yet another embodiment, an assay of the present invention is a cell-free assay in which a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or biologically active portion thereof, is contacted with a test compound and the ability of the test compound to bind to the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or biologically active portion thereof is determined. Preferred biologically active portions of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins to be used in assays of the present invention include fragments which participate in interactions with non-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 molecules, e.g., fragments with high surface probability scores. Binding of the test compound to the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be determined either directly or indirectly as described above. In a preferred embodiment, the assay includes contacting the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or biologically active portion thereof with a known compound which binds 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 to form an assay mixture, contacting the assay mixture with a test compound, and determining the ability of the test compound to interact with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, wherein determining the ability of the test compound to interact with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein comprises determining the ability of the test compound to preferentially bind to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 or biologically active portion thereof as compared to the known compound. Compounds that modulate the interaction of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 with a known target protein may be useful in regulating the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, especially a mutant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein.

In another embodiment, the assay is a cell-free assay in which a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or biologically active portion thereof is contacted with a test compound and the ability of the test compound to modulate (e.g., stimulate or inhibit) the activity of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or biologically active portion thereof is determined. Determining the ability of the test compound to modulate the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be accomplished, for example, by determining the ability of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to bind to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule by one of the methods described above for determining direct binding. Determining the ability of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to bind to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule can also be accomplished using a technology such as real-time Biomolecular Interaction Analysis (BIA) (Sjolander, S. and Urbaniczky, C. (1991) *Anal. Chem.* 63:2338-2345 and Szabo et al. (1995) *Curr. Opin. Struct. Biol.* 5:699-705). As used herein, "BIA" is a technology for studying biospecific interactions in real time, without labeling any of the interactants (e.g., BIAcore). Changes in the optical phenomenon of surface plasmon resonance (SPR) can be used as an indication of real-time reactions between biological molecules.

In another embodiment, determining the ability of the test compound to modulate the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be accomplished by determining the ability of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to further modulate the activity of a downstream effector of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule. For example, the activity of the effector molecule on an appropriate target can be determined or the binding of the effector to an appropriate target can be determined as previously described.

In yet another embodiment, the cell-free assay involves contacting a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or biologically active portion thereof with a known compound which binds the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to form an assay mixture, contacting the assay mixture with a test compound, and determining the ability of the test compound to interact with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, wherein determining the ability of the test compound to interact with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein comprises determining the ability of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to preferentially bind to or modulate the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule.

In more than one embodiment of the above assay methods of the present invention, it may be desirable to immobilize either 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 or its target molecule to facilitate separation of complexed from uncomplexed forms of one or both of the proteins, as well as to accommodate automation of the assay. Binding of a test compound to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, or interaction of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein with a target molecule in the presence and absence of a candidate compound, can be accomplished in any vessel suitable for containing the reactants. Examples of such vessels include microtitre plates, test tubes, and micro-centrifuge tubes. In one embodiment, a fusion protein can be provided which adds a domain that allows one or both of the proteins to be bound to a matrix. For example, glutathione-S-transferase/44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion proteins or glutathione-S-transferase/target fusion proteins can be adsorbed onto glutathione sepharose beads (Sigma Chemical, St. Louis, Mo.) or glutathione derivatized microtitre plates, which are then combined with the test compound or the test compound and either the non-adsorbed target protein or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, and the mixture incubated under conditions conducive to complex formation (e.g., at physiological conditions for salt and pH). Following incubation, the beads or microtitre plate wells are washed to remove any unbound components, the matrix immobilized in the case of beads, complex determined either directly or indirectly, for example, as described above. Alternatively, the complexes can be dissociated from the matrix, and the level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 binding or activity determined using standard techniques.

Other techniques for immobilizing proteins on matrices can also be used in the screening assays of the invention. For example, either a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 target molecule can be immobilized utilizing conjugation of biotin and streptavidin. Biotinylated 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or target molecules can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). Alternatively, antibodies reactive with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or target molecules but which do not interfere with binding of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to its target molecule can be derivatized to the wells of the plate, and unbound target or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein trapped in the wells by antibody conjugation. Methods for detecting such complexes, in addition to those described above for the GST-immobilized complexes, include immunodetection of complexes using antibodies reactive with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or target molecule, as well as enzyme-linked assays which rely on detecting an enzymatic activity associated with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or target molecule.

In another embodiment, modulators of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression are identified in a method wherein a cell is contacted with a candidate compound and the expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein in the cell is determined. The level of expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein in the presence of the candidate compound is compared to the level of expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein in the absence of the candidate compound. The candidate compound can then be identified as a modulator of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643,-2543, 9626, 13231, 32409, 84260, 2882, 8203, 32678 or 55053 expression based on this comparison. For example, when expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein is greater (statistically significantly greater) in the presence of the candidate compound than in its absence, the candidate compound is identified as a stimulator of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein expression. Alternatively, when expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein is less (statistically significantly less) in the presence of the candidate compound than in its absence, the candidate compound is identified as an inhibitor of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein expression. The level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein expression in the cells can be determined by methods described herein for detecting 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or protein.

In yet another aspect of the invention, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300), to identify other proteins, which bind to or interact with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 ("44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-binding proteins" or "44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-bp") and are involved in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. Such 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-binding proteins are also likely to be involved in the propagation of signals by the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 targets as, for example, downstream elements of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-mediated signaling pathway. Alternatively, such 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-binding proteins are likely to be 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 inhibitors.

The two-hybrid system is based on the modular nature of most transcription factors, which consist of separable DNA-binding and activation domains. Briefly, the assay utilizes two different DNA constructs. In one construct, the gene that codes for a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein.

In another aspect, the invention pertains to a combination of two or more of the assays described herein. For example, a modulating agent can be identified using a cell-based or a cell free assay, and the ability of the agent to modulate the activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be confirmed in vivo, e.g., in an animal such as an animal model for a urological disorder, as described herein.

This invention further pertains to novel agents identified by the above-described screening assays. Accordingly, it is within the scope of this invention to further use an agent identified as described herein in an appropriate animal model. For example, an agent identified as described herein (e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulating agent, an antisense 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecule, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-specific antibody, or a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

Any of the compounds, including but not limited to compounds such as those identified in the foregoing assay systems, may be tested for the ability to ameliorate at least one symptom of a urological disorder. Cell-based and animal model-based assays for the identification of compounds exhibiting such an ability to ameliorate at least one symptom of a urological disorder are described herein.

In addition, animal-based models of a urological disorder, such as those described herein, may be used to identify compounds capable of treating a urological disorder. Such animal models may be used as test substrates for the identification of drugs, pharmaceuticals, therapies, and interventions which may be effective in treating a urological disorder. For example, animal models may be exposed to a compound, suspected of exhibiting an ability to treat a urological disorder, at a sufficient concentration and for a time sufficient to elicit such an amelioration of at least one symptom of a urological disorder in the exposed animals. The response of the animals to the exposure may be monitored by assessing the reversal of the symptoms of a urological disorder before and after treatment.

With regard to intervention, any treatments which reverse any aspect of aurological disorder (i.e. have an effect on UI and/or BPH) should be considered as candidates for a human urological disorder therapeutic intervention. Dosages of test agents may be determined by deriving dose-response curves.

Additionally, gene expression patterns may be utilized to assess the ability of a compound to ameliorate at least one symptom of a urological disorder. For example, the expression pattern of one or more genes may form part of a "gene expression profile" or "transcriptional profile" which may be then be used in such an assessment. "Gene expression profile" or "transcriptional profile", as used herein, includes the pattern of mRNA expression obtained for a given tissue or cell type under a given set of conditions. Gene expression profiles may be generated, for example, by utilizing a differential display procedure, Northern analysis and/or RT-PCR. In one embodiment, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences may be used as probes and/or PCR primers for the generation and corroboration of such gene expression profiles.

Gene expression profiles may be characterized for known states, either urological disorder or normal, within the cell- and/or animal-based model systems. Subsequently, these known gene expression profiles may be compared to ascertain the effect a test compound has to modify such gene expression profiles, and to cause the profile to more closely resemble that of a more desirable profile.

For example, administration of a compound may cause the gene expression profile of a urological disorder disease model system to more closely resemble the control system. Administration of a compound may, alternatively, cause the gene expression profile of a control system to begin to mimic a urological disorder or a urological disorder disease state. Such a compound may, for example, be used in further characterizing the compound of interest, or may be used in the generation of additional animal models.

Cell- and Animal-Based Model Systems

Described herein are cell- and animal-based systems which act as models for urological disorder. These systems may be used in a variety of applications. For example, the cell- and animal-based model systems may be used to further characterize differentially expressed genes associated with a urological disorder, e.g., 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053. In addition, animal- and cell-based assays may be used as part of screening strategies designed to identify compounds which are capable of ameliorating at least one symptom of a urological disorder, as described, below. Thus, the animal- and cell-based models may be used to identify drugs, pharmaceuticals, therapies and interventions which may be effective in treating a urological disorder. Furthermore, such animal models may be used to determine the LD50 and the ED50 in animal subjects, and such data can be used to determine the in vivo efficacy of potential urological disorder treatments.

Animal-Based Systems

Animal-based model systems of urological disorder may include, but are not limited to, non-recombinant and engineered transgenic animals.

Non-recombinant animal models for urological disorder may include, for example, genetic models.

Additionally, animal models exhibiting a urological disorder may be engineered by using, for example, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences described above, in conjunction with techniques for producing transgenic animals that are well known to those of skill in the art. For example, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences may be introduced into, and overexpressed in, the genome of the animal of interest, or, if endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences are present, they may either be overexpressed or, alternatively, be disrupted in order to underexpress or inactivate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression.

The host cells of the invention can also be used to produce non-human transgenic animals. For example, in one embodiment, a host cell of the invention is a fertilized oocyte or an embryonic stem cell into which 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-coding sequences have been introduced. Such host cells can then be used to create non-human transgenic animals in which exogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequences have been introduced into their genome or homologous recombinant animals in which endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequences have been altered. Such animals are useful for studying the function and/or activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 and for identifying and/or evaluating modulators of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, and the like. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene has been altered by homologous recombination between the endogenous gene and an exogenous DNA molecule introduced into a cell of the animal, e.g., an embryonic cell of the animal, prior to development of the animal.

A transgenic animal used in the methods of the invention can be created by introducing a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-encoding nucleic acid into the male pronuclei of a fertilized oocyte, e.g., by microinjection, retroviral infection, and allowing the oocyte to develop in a pseudopregnant female foster animal. The 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 cDNA sequence can be introduced as a transgene into the genome of a non-human animal. Alternatively, a nonhuman homologue of a human 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, such as a mouse or rat 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, can be used as a transgene. Alternatively, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene homologue, such as another 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 family member, can be isolated based on hybridization to the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 cDNA sequences and used as a transgene. Intronic sequences and polyadenylation signals can also be included in the transgene to increase the efficiency of expression of the transgene. A tissue-specific regulatory sequence(s) can be operably linked to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 transgene to direct expression of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to particular cells. Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., *Manipulating the Mouse Embryo,* (Cold Spring Harbor Laboratory Press, Cold Spring Harbor, N.Y., 1986). Similar methods are used for production of other transgenic animals. A transgenic founder animal can be identified based upon the presence of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 transgene in its genome and/or expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA in tissues or cells of the animals. A transgenic founder animal can then be used to breed additional animals carrying the transgene. Moreover, transgenic animals carrying a transgene encoding a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can further be bred to other transgenic animals carrying other transgenes.

To create a homologous recombinant animal, a vector is prepared which contains at least a portion of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene into which a deletion, addition or substitution has been introduced to thereby alter, e.g., functionally disrupt, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene. The 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene can be a human gene but more preferably, is a non-human homologue of a human 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene. For example, a rat 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene can be used to construct a homologous recombination nucleic acid molecule, e.g., a vector, suitable for altering an endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene in the mouse genome. In a preferred embodiment, the homologous recombination nucleic acid molecule is designed such that, upon homologous recombination, the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene is functionally disrupted (i.e., no longer encodes a functional protein; also referred to as a "knock out" vector). Alternatively, the homologous recombination nucleic acid molecule can be designed such that, upon homologous recombination, the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene is mutated or otherwise altered but still encodes functional protein (e.g., the upstream regulatory region can be altered to thereby alter the expression of the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein). In the homologous recombination nucleic acid molecule, the altered portion of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene is flanked at its 5' and 3' ends by additional nucleic acid sequence of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene to allow for homologous recombination to occur between the exogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene carried by the homologous recombination nucleic acid molecule and an endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene in a cell, e.g., an embryonic stem cell. The additional flanking 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid sequence is of sufficient length for successful homologous recombination with the endogenous gene. Typically, several kilobases of flanking DNA (both at the 5' and 3' ends) are included in the homologous recombination nucleic acid molecule (see, e.g., Thomas, K. R. and Capecchi, M. R. (1987) *Cell* 51:503 for a description of homologous recombination vectors). The homologous recombination nucleic acid molecule is introduced into a cell, e.g., an embryonic stem cell line (e.g., by electroporation) and cells in which the introduced 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene has homologously recombined with the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene are selected (see e.g., Li, E. et al. (1992) *Cell* 69:915). The selected cells can then injected into a blastocyst of an animal (e.g., a mouse) to form aggregation chimeras (see e.g., Bradley, A. in *Teratocarcinomas and Embryonic Stem Cells: A Practical Approach*, E. J. Robertson, ed. (IRL, Oxford, 1987) pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination nucleic-acid molecules, e.g., vectors, or homologous recombinant animals are described further in Bradley, A. (1991) *Current Opinion in Biotechnology* 2:823-829 and in PCT International Publication Nos.: WO 90/11354 by Le Mouellec et al.; WO 91/01140 by Smithies et al.; WO 92/0968 by Zijlstra et al.; and WO 93/04169 by Berns et al.

In another embodiment, transgenic non-human animals for use in the methods of the invention can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of *Saccharomyces cerevisiae* (O'Gorman et al. (1991) *Science* 251:1351-1355. If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. (1997) *Nature* 385:810-813 and PCT International Publication Nos. WO 97/07668 and WO 97/07669. In brief, a cell, e.g., a somatic cell, from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyte and then transferred to pseudopregnant female foster animal. The offspring borne of this female foster animal will be a clone of the animal from which the cell, e.g., the somatic cell, is isolated.

The 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 transgenic animals that express 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 peptide (detected immunocytochemically, using antibodies directed against 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 epitopes) at easily detectable levels should then be further evaluated to identify those animals which display a characteristic urological disorder.

Cell-Based Systems

Cells that contain and express 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences which encode a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, and, further, exhibit cellular phenotypes associated with BPH and/or UI, may be used to identify compounds that exhibit an effect on a urological disorder. Such cells may include non-recombinant monocyte cell lines, such as U937 (ATCC# CRL-1593), THP-1 (ATCC#TIB-202), and P388D1 (ATCC# TIB-63); endothelial cells such as human umbilical vein endothelial cells (HUVECs), human microvascular endothelial cells (HM-VEC), and bovine aortic endothelial cells (BAECs); as well as generic mammalian cell lines such as HeLa cells and COS cells, e.g., COS-7 (ATCC# CRL-1651), prostate and bladder cell lines. Further, such cells may include recombinant, transgenic cell lines. For example, the urological disorder animal models of the invention, discussed above, may be used to generate cell lines, containing one or more cell types involved in BPH and/or UI, that can be used as cell culture models for this disorder. While primary cultures derived from the urological disorder model transgenic animals of the invention may be utilized, the generation of continuous cell lines is preferred. For examples of techniques which may be used to derive a continuous cell line from the transgenic animals, see Small et al., (1985) *Mol. Cell Biol.* 5:642-648.

Alternatively, cells of a cell type known to be involved in BPH and/or UI may be transfected with sequences capable of increasing or decreasing the amount of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression within the cell. For example, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences may be introduced into, and overexpressed in, the genome of the cell of interest, or, if endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences are present, they may be either overexpressed or, alternatively disrupted in order to underexpress or inactivate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression.

In order to overexpress a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, the coding portion of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene may be ligated to a regulatory sequence which is capable of driving gene expression in the cell type of interest, e.g., an endothelial cell. Such regulatory regions will be well known to those of skill in the art, and may be utilized in the absence of undue experimentation. Recombinant methods for expressing target genes are described above.

For underexpression of an endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequence, such a sequence may be isolated and engineered such that when reintroduced into the genome of the cell type of interest, the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 alleles will be inactivated. Preferably, the engineered 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequence is introduced via gene targeting such that the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequence is disrupted upon integration of the engineered 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequence into the cell's genome. Transfection of host cells with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 genes is discussed, above.

Cells treated with compounds or transfected with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 genes can be examined for phenotypes associated with BPH and/or UI.

Transfection of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid may be accomplished by using standard techniques (described in, for example, Ausubel (1989) supra). Transfected cells should be evaluated for the presence of the recombinant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences, for expression and accumulation of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA, and for the presence of recombinant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein production. In instances wherein a decrease in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression is desired, standard techniques may be used to demonstrate whether a decrease in endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression and/or in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein production is achieved.

Also provided are cells or a purified preparation thereof, e.g., human cells, in which an endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 is under the control of a regulatory sequence that does not normally control the expression of the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 553010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene. The expression characteristics of an endogenous gene within a cell, e.g., a cell line or microorganism, can be modified by inserting a heterologous DNA regulatory element into the genome of the cell such that the inserted regulatory element is operably linked to the endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene. For example, an endogenous 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, e.g., a gene which is "transcriptionally silent," e.g., not normally expressed, or expressed only at very low levels, may be activated by inserting a regulatory element which is capable of promoting the expression of a normally expressed gene product in that cell. Techniques such as targeted homologous recombinations, can be used to insert the heterologous DNA as described in, e.g., Chappel, U.S. Pat. No. 5,272,071; WO 91/06667, published on May 16, 1991.

Predictive Medicine

The present invention also pertains to the field of predictive medicine in which diagnostic assays, prognostic assays, and monitoring clinical trials are used for prognostic (predictive) purposes to thereby treat an individual prophylactically. Accordingly, one aspect of the present invention relates to diagnostic assays for determining 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein and/or nucleic acid expression as well as 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity, in the context of a biological sample (e.g., blood, serum, cells, e.g., endothelial cells, or tissue, e.g., vascular tissue, bladder tissue or prostate tissue) to thereby determine whether an individual is afflicted with a predisposition or is experiencing a urological disorder. The invention also provides for prognostic (or predictive) assays for determining whether an individual is at risk of developing a urological disorder. For example, mutations in a44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene can be assayed for in a biological sample. Such assays can be used for prognostic or predictive purpose to thereby phophylactically treat an individual prior to the onset of a urological disorder.

Another aspect of the invention pertains to monitoring the influence of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulators (e.g., anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 ribozymes) on the expression or activity of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 in clinical trials.

These and other agents are described in further detail in the following sections.

Diagnostic Assays

To determine whether a subject is afflicted with a disease, a biological sample may be obtained from a subject and the biological sample may be contacted with a compound or an agent capable of detecting a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or nucleic acid (e.g., mRNA or genomic DNA) that encodes a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, in the biological sample. A preferred agent for detecting 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or genomic DNA is a labeled nucleic acid probe capable of hybridizing to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or genomic DNA. The nucleic acid probe can be, for example, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid set forth in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 or a portion thereof, such as an oligonucleotide of at least 15, 20, 25, 30, 25, 40, 45, 50, 100, 250 or 500 nucleotides in length and sufficient to specifically hybridize under stringent conditions to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA or genomic DNA. Other suitable probes for use in the diagnostic assays of the invention are described herein.

A preferred agent for detecting 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein in a sample is an antibody capable of binding to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, preferably an antibody with a detectable label. Antibodies can be polyclonal, or more preferably, monoclonal. An intact antibody, or a fragment thereof (e.g., Fab or F(ab)2) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

The term "biological sample" is intended to include tissues, cells, and biological fluids isolated from a subject, as well as tissues, cells, and fluids present within a subject. That is, the detection method of the invention can be used to detect 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA, protein, or genomic DNA in a biological sample in vitro as well as in vivo. For example, in vitro techniques for detection of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA include Northern hybridizations and in situ hybridizations. In vitro techniques for detection of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein include enzyme linked immunosorbent assays (ELISAs), Western blots, immunoprecipitations and immunofluorescence. In vitro techniques for detection of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 genomic DNA include Southern hybridizations. Furthermore, in vivo techniques for detection of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein include introducing into a subject a labeled anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody. For example, the antibody can be labeled with a radioactive marker whose presence and location in a subject can be detected by standard imaging techniques.

In another embodiment, the methods further involve obtaining a control biological sample from a control subject, contacting the control sample with a compound or agent capable of detecting 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA, or genomic DNA, such that the presence of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA or genomic DNA is detected in the biological sample, and comparing the presence of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA or genomic DNA in the control sample with the presence of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA or genomic DNA in the test sample.

Prognostic Assays

The present invention further pertains to methods for identifying subjects having or at risk of developing a disease associated with aberrant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity.

As used herein, the term "aberrant" includes a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity which deviates from the wild type 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity. Aberrant expression or activity includes increased or decreased expression or activity, as well as expression or activity which does not follow the wild type developmental pattern of expression or the subcellular pattern of expression. For example, aberrant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity is intended to include the cases in which a mutation in the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene causes the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene to be under-expressed or over-expressed and situations in which such mutations result in a non-functional 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or a protein which does not function in a wild-type fashion, e.g., a protein which does not interact with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate, or one which interacts with a non-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate.

The assays described herein, such as the preceding diagnostic assays or the following assays, can be used to identify a subject having or at risk of developing a disease. A biological sample may be obtained from a subject and tested for the presence or absence of a genetic alteration. For example, such genetic alterations can be detected by ascertaining the existence of at least one of 1) a deletion of one or more nucleotides from a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, 2) an addition of one or more nucleotides to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, 3) a substitution of one or more nucleotides of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, 4) a chromosomal rearrangement of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, 5) an alteration in the level of a messenger RNA transcript of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, 6) aberrant modification of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, such as of the methylation pattern of the genomic DNA, 7) the presence of a non-wild type splicing pattern of a messenger RNA transcript of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, 8) a non-wild type level of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-protein, 9) allelic loss of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, and 10) inappropriate post-translational modification of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-protein.

As described herein, there are a large number of assays known in the art which can be used for detecting genetic alterations in a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene. For example, a genetic alteration in a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene may be detected using a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) *Science* 241:1077-1080; and Nakazawa et al. (1994) *Proc. Natl. Acad. Sci. USA* 91:360-364), the latter of which can be particularly useful for detecting point mutations in a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene (see Abravaya et al. (1995) *Nucleic Acids Res.* 23:675-682). This method includes collecting a biological sample from a subject, isolating nucleic acid (e.g., genomic DNA, mRNA or both) from the sample, contacting the nucleic acid sample with one or more primers which specifically hybridize to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene under conditions such that hybridization and amplification of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self sustained sequence replication (Guatelli, J. C. et al. (1990) *Proc. Natl. Acad. Sci. USA* 87:1874-1878), transcriptional amplification system (Kwoh, D. Y. et al. (1989) *Proc. Natl. Acad. Sci. USA* 86:1173-1177), Q-Beta Replicase (Lizardi, P. M. et al. (1988) *Bio-Technology* 6:1197), or any other nucleic acid amplification method, followed by the detection of the amplified molecules using techniques well known to those of skill in the art. These detection schemes are especially useful for the detection of nucleic acid molecules if such molecules are present in very low numbers.

In an alternative embodiment, mutations in a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene from a biological sample can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be identified by hybridizing biological sample derived and control nucleic acids, e.g., DNA or RNA, to high density arrays containing hundreds or thousands of oligonucleotide probes (Cronin, M. T. et al. (1996) *Human Mutation* 7:244-255; Kozal, M. J. et al. (1996) *Nature Medicine* 2:753-759). For example, genetic mutations in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be identified in two dimensional arrays containing light-generated DNA probes as described in Cronin, M. T. et al. (1996) supra. Briefly, a first hybridization array of probes can be used to scan through long stretches of DNA in a sample and control to identify base changes between the sequences by making linear arrays of sequential, overlapping probes. This step allows for the identification of point mutations. This step is followed by a second hybridization array that allows for the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene in a biological sample and detect mutations by comparing the sequence of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 in the biological sample with the corresponding wild-type (control) sequence. Examples of sequencing reactions include those based on techniques developed by Maxam and Gilbert (1977) *Proc. Natl. Acad. Sci. USA* 74:560) or Sanger (1977) *Proc. Natl. Acad. Sci. USA* 74:5463). It is also contemplated that any of a variety of automated sequencing procedures can be utilized when performing the diagnostic assays (Naeve, C. W. (1995) *Biotechniques* 19:448-53), including sequencing by mass spectrometry (see, e.g., PCT International Publication No. WO 94/16101; Cohen et al. (1996) *Adv. Chromatogr.* 36:127-162; and Griffin et al. (1993) *Appl. Biochem. Biotechnol.* 38:147-159).

Other methods for detecting mutations in the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene include methods in which protection from cleavage agents is used to detect mismatched bases in RNA/RNA or RNA/DNA heteroduplexes (Myers et al. (1985) *Science* 230:1242). In general, the art technique of "mismatch cleavage" starts by providing heteroduplexes formed by hybridizing (labeled) RNA or DNA containing the wild-type 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequence with potentially mutant RNA or DNA obtained from a tissue sample. The double-stranded duplexes are treated with an agent which cleaves single-stranded regions of the duplex such as which will exist due to basepair mismatches between the control and sample strands. For instance, RNA/DNA duplexes can be treated with RNase and DNA/DNA hybrids treated with S1 nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al. (1988) *Proc. Natl Acad Sci USA* 85:4397 and Saleeba et al. (1992) *Methods Enzymol.* 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662). According to an exemplary embodiment, a probe based on a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequence, e.g., a wild-type 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequence, is hybridized to a cDNA or other DNA product from a test cell(s). The duplex is treated with a DNA mismatch repair enzyme, and the cleavage products, if any, can be detected from electrophoresis protocols or the like. See, for example, U.S. Pat. No. 5,459,039.

In other embodiments, alterations in electrophoretic mobility will be used to identify mutations in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 genes. For example, single strand conformation polymorphism (SSCP) may be used to detect differences in electrophoretic mobility between mutant and wild type nucleic acids (Orita et al. (1989) *Proc Natl. Acad. Sci USA*: 86:2766; see also Cotton (1993) *Mutat. Res.* 285:125-144 and Hayashi (1992) *Genet. Anal. Tech. Appl.* 9:73-79). Single-stranded DNA fragments of sample and control 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet* 7:5).

In yet another embodiment the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to ensure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys Chem* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163); Saiki et al. (1989) *Proc. Natl Acad. Sci USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell Probes* 6: 1). It is anticipated that in certain embodiments amplification may also be performed using Taq ligase for amplification (Barany (1991) *Proc. Natl. Acad. Sci USA* 88:189). In such cases, ligation will occur only if there is a perfect match at the 3' end of the 5' sequence making it possible to detect the presence of a known mutation at a specific site by looking for the presence or absence of amplification.

Furthermore, the prognostic assays described herein can be used to determine whether a subject can be administered a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulator (e.g., an agonist, antagonist, peptidomimetic, protein, peptide, nucleic acid, or small molecule) to effectively treat a disease.

Monitoring of Effects During Clinical Trials

The present invention further provides methods for determining the effectiveness of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulator (e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulator identified herein) in treating a disease. For example, the effectiveness of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulator in increasing 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression, protein levels, or in upregulating 44390, 54181, 211, 5687, 884, 1405, 636, 4421, 5410, 30905, 2045, 16405, 18560, 2047, 33751, 52872, 14063, 20739,;32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity, can be monitored in clinical trials of subjects exhibiting decreased 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression, protein levels, or downregulated 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. Alternatively, the effectiveness of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulator in decreasing 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression, protein levels, or in downregulating 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity, can be monitored in clinical trials of subjects exhibiting increased 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression, protein levels, or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. In such clinical trials, the expression or activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, and preferably, other genes that have been implicated in nociception can be used as a "read out" or marker of the phenotype of a particular cell.

For example, and not by way of limitation, genes, including 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053, that are modulated in cells by treatment with an agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity (e.g., identified in a screening assay as described herein) can be identified. Thus, to study the effect of agents which modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity on subjects suffering from a urological disorder in, for example, a clinical trial, cells can be isolated and RNA prepared and analyzed for the levels of expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 and other genes implicated in the urological disorder. The levels of gene expression (e.g., a gene expression pattern) can be quantified by Northern blot analysis or RT-PCR, as described herein, or alternatively by measuring the amount of protein produced, by one of the methods described herein, or by measuring the levels of activity of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 or other genes. In this way, the gene expression pattern can serve as a marker, indicative of the physiological response of the cells to the agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. This response state may be determined before, and at various points during treatment of the individual with the agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity.

In a preferred embodiment, the present invention provides a method for monitoring the effectiveness of treatment of a subject with an agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity (e.g., an agonist, antagonist, peptidomimetic, protein, peptide, nucleic acid, or small molecule identified by the screening assays described herein) including the steps of (i) obtaining a pre-administration sample from a subject prior to administration of the agent; (ii) detecting the level of expression of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA, or genomic DNA in the pre-administration sample; (iii) obtaining one or more post-administration samples from the subject; (iv) detecting the level of expression or activity of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA, or genomic DNA in the post-administration samples; (v) comparing the level of expression or activity of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA, or genomic DNA in the pre-administration sample with the 44390, 54181, 211; 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, mRNA, or genomic DNA in the post administration sample or samples; and (vi) altering the administration of the agent to the subject accordingly. For example, increased administration of the agent may be desirable to increase the expression or activity of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 to higher levels than detected, i.e., to increase the effectiveness of the agent. Alternatively, decreased administration of the agent may be desirable to decrease expression or activity of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 to lower levels than detected, i.e. to decrease the effectiveness of the agent. According to such an embodiment, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity may be used as an indicator of the effectiveness of an agent, even in the absence of an observable phenotypic response.

Methods of Treatment:

The present invention provides for both prophylactic and therapeutic methods of treating a subject, e.g., a human, at risk of (or susceptible to) a disease. With regard to both prophylactic and therapeutic methods of treatment, such treatments may be specifically tailored or modified, based on knowledge obtained from the field of pharmacogenomics. "Pharmacogenomics," as used herein, refers to the application of genomics technologies such as gene sequencing, statistical genetics, and gene expression analysis to drugs in clinical development and on the market. More specifically, the term refers to the study of how a patient's genes determine his or her response to a drug (e.g., a patient's "drug response phenotype", or "drug response genotype").

Thus, another aspect of the invention provides methods for tailoring an subject's prophylactic or therapeutic treatment with either the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 molecules of the present invention or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Prophylactic Methods

In one aspect, the invention provides a method for preventing in a subject, a disease by administering to the subject an agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. Subjects at risk for a urological disorder, e.g., BPH and/or UI, can be identified by, for example, any or a combination of the diagnostic or prognostic assays described herein. Administration of a prophylactic agent can occur prior to the manifestation of symptoms characteristic of aberrant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity, such that a disease is prevented or, alternatively, delayed in its progression. Depending on the type of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 aberrancy, for example, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 agonist or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antagonist agent can be used for treating the subject. The appropriate agent can be determined based on screening assays described herein.

Therapeutic Methods

Described herein are methods and compositions whereby a urological disorder may be ameliorated. Certain urological disorders are brought about, at least in part, by an excessive level of a gene product, or by the presence of a gene product exhibiting an abnormal or excessive activity. As such, the reduction in the level and/or activity of such gene products would bring about the amelioration of at least one symptom of a urological disorder. Techniques for the reduction of gene expression levels or the activity of a protein are discussed below.

Alternatively, certain other urological disorders are brought about, at least in part, by the absence or reduction of the level of gene expression, or a reduction in the level of a protein's activity. As such, an increase in the level of gene expression and/or the activity of such proteins would bring about the amelioration of at least one symptom of a urological disorder.

In some cases, the up-regulation of a gene in a disease state reflects a protective role for that gene product in responding to the disease condition. Enhancement of such a gene's expression, or the activity of the gene product, will reinforce the protective effect it exerts. Some urological disease states may result from an abnormally low level of activity of such a protective gene. In these cases also, an increase in the level of gene expression and/or the activity of such gene products would bring about the amelioration of a least one symptom of a urological disorder. Techniques for increasing target gene expression levels or target gene product activity levels are discussed herein.

Accordingly, another aspect of the invention pertains to methods of modulating 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity for therapeutic purposes. Accordingly, in an exemplary embodiment, the modulatory method of the invention involves contacting a cell with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 or agent that modulates one or more of the activities of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein activity associated with the cell (e.g., an endothelial cell, ovarian cell, bladder cell and prostate cell). An agent that modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein activity can be an agent as described herein, such as a nucleic acid or a protein, a naturally-occurring target molecule of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein (e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 ligand or substrate), a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 agonist or antagonist, a peptidomimetic of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 agonist or antagonist, or other small molecule. In one embodiment, the agent stimulates one or more 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activities. Examples of such stimulatory agents include active 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein and a nucleic acid molecule encoding 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 that has been introduced into the cell. In another embodiment, the agent inhibits one or more 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activities. Examples of such inhibitory agents include antisense 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecules, anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies, and 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 inhibitors. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant or unwanted expression or activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or nucleic acid molecule. In one embodiment, the method involves administering an agent (e.g., an agent identified by a screening assay described herein), or combination of agents that modulates (e.g., upregulates or downregulates) 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity. In another embodiment, the method involves administering a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or nucleic acid molecule as therapy to compensate for reduced, aberrant, or unwanted 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity.

Stimulation of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is desirable in situations in which 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 is abnormally downregulated and/or in which increased 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is likely to have a beneficial effect. Likewise, inhibition of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is desirable in situations in which 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 is abnormally upregulated and/or in which decreased 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is likely to have a beneficial effect.

Methods for Inhibiting Target Gene Expression, Synthesis, or Activity

As discussed above, genes involved in urological disorders may cause such disorders via an increased level of gene activity. In some cases, such up-regulation may have a causative or exacerbating effect on the disease state. A variety of techniques may be used to inhibit the expression, synthesis, or activity of such genes and/or proteins.

For example, compounds such as those identified through assays described above, which exhibit inhibitory activity, may be used in accordance with the invention to ameliorate at least one symptom of a urological disorder. Such molecules may include, but are not limited to, small organic molecules, peptides, antibodies, and the like.

For example, compounds can be administered that compete with endogenous ligand for the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. The resulting reduction in the amount of ligand-bound 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein will modulate endothelial cell physiology. Compounds that can be particularly useful for this purpose include, for example, soluble proteins or peptides, such as peptides comprising one or more of the extracellular domains, or portions and/or analogs thereof, of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, including, for example, soluble fusion proteins such as Ig-tailed fusion proteins. (For a discussion of the production of Ig-tailed fusion proteins, see, for example, U.S. Pat. No. 5,116,964). Alternatively, compounds, such as ligand analogs or antibodies, that bind to the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 receptor site, but do not activate the protein, (e.g., receptor-ligand antagonists) can be effective in inhibiting 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein activity.

Further, antisense and ribozyme molecules which inhibit expression of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene may also be used in accordance with the invention to inhibit aberrant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene activity. Still further, triple helix molecules may be utilized in inhibiting aberrant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene activity.

The antisense nucleic acid molecules used in the methods of the invention are typically administered to a subject or generated in situ such that they hybridize with or bind to cellular mRNA and/or genomic DNA encoding a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. An example of a route of administration of antisense nucleic acid molecules of the invention include direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic-acid molecule is placed under the control of a strong pol II or pol III promoter are preferred.

In yet another embodiment, an antisense nucleic acid molecule used in the methods of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

In still another embodiment, an antisense nucleic acid used in the methods of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA transcripts to thereby inhibit translation of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA. A ribozyme having specificity for a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-encoding nucleic acid can be designed based upon the nucleotide sequence of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 cDNA disclosed herein (i.e., NO:1). For example, a derivative of a Tetrahymena L-19 IVS RNA can be constructed in which the nucleotide sequence of the active site is complementary to the nucleotide sequence to be cleaved in a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-encoding mRNA (see, for example, Cech et al. U.S. Pat. No. 4,987,071; and Cech et al. U.S. Pat. No. 5,116,742). Alternatively, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA can be used to select a catalytic RNA having a specific ribonuclease activity from a pool of RNA molecules (see, for example, Bartel, D. and Szostak, J. W. (1993) *Science* 261:1411-1418).

44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression can also be inhibited by targeting nucleotide sequences complementary to the regulatory region of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 (e.g., the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 promoter and/or enhancers) to form triple helical structures that prevent transcription of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene in target cells (see, for example, Helene, C. (1991) *Anticancer Drug Des.* 6(6):569-84; Helene, C. et al. (1992) *Ann. N.Y. Acad. Sci.* 660:27-36; and Maher, L. J. (1992) *Bioassays* 14(12): 807-15).

Antibodies that are both specific for the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein and interfere with its activity may also be used to modulate or inhibit 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein function. Such antibodies may be generated using standard techniques described herein, against the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein itself or against peptides corresponding to portions of the protein. Such antibodies include but are not limited to polyclonal, monoclonal, Fab fragments, single chain antibodies, or chimeric antibodies.

In instances where the target gene protein is intracellular and whole antibodies are used, internalizing antibodies may be preferred. Lipofectin liposomes may be used to deliver the antibody or a fragment of the Fab region which binds to the target epitope into cells. Where fragments of the antibody are used, the smallest inhibitory fragment which binds to the target protein's binding domain is preferred. For example, peptides having an amino acid sequence corresponding to the domain of the variable region of the antibody that binds to the target gene protein may be used. Such peptides may be synthesized chemically or produced via recombinant DNA technology using methods well known in the art (described in, for example, Creighton (1983), supra; and Sambrook et al. (1989) supra). Single chain neutralizing antibodies which bind to intracellular target gene epitopes may also be administered. Such single chain antibodies may be administered, for example, by expressing nucleotide sequences encoding single-chain antibodies within the target cell population by utilizing, for example, techniques such as those described in Marasco et al. (1993) *Proc. Natl. Acad. Sci. USA* 90:7889-7893).

In some instances, the target gene protein is extracellular, or is a transmembrane protein, such as the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Antibodies that are specific for one or more extracellular domains of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, for example, and that interfere with its activity, are particularly useful in treating urological disorder or a urological disorder. Such antibodies are especially efficient because they can access the target domains directly from the bloodstream. Any of the administration techniques described below which are appropriate for peptide administration may be utilized to effectively administer inhibitory target gene antibodies to their site of action.

Methods for Restoring or Enhancing Target Gene Activity

Genes that cause a urological disorder may be underexpressed within BPH and/or UI. Alternatively, the activity of the protein products of such genes may be decreased, leading to the development of urological disorder. Such down-regulation of gene expression or decrease of protein activity might have a causative or exacerbating effect on the disease state.

In some cases, genes that are up regulated in the disease state might be exerting a protective effect. A variety of techniques may be used to increase the expression, synthesis, or activity of genes and/or proteins that exert a protective effect in response to a urological disorder.

Described in this section are methods whereby the level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity may be increased to levels wherein the symptoms of the urological disorder are ameliorated. The level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity may be increased, for example, by either increasing the level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene expression or by increasing the level of active 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein which is present.

For example, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, at a level sufficient to ameliorate at least one symptom of a urological disorder may be administered to a patient exhibiting such symptoms. Any of the techniques discussed below may be used for such administration. One of skill in the art will readily know how to determine the concentration of effective, non-toxic doses of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, utilizing techniques such as those described below.

Additionally, RNA sequences encoding a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein may be directly administered to a patient exhibiting a urological disorder, at a concentration sufficient to produce a level of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein such that a urological disorder are ameliorated. Any of the techniques discussed below, which achieve intracellular administration of compounds, such as, for example, liposome administration, may be used for the administration of such RNA molecules. The RNA molecules may be produced, for example, by recombinant techniques such as those described herein.

Further, subjects may be treated by gene replacement therapy. One or more copies of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene, or a portion thereof, that directs the production of a normal 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 function, may be inserted into cells using vectors which include, but are not limited to adenovirus, adeno-associated virus, and retrovirus vectors, in addition to other particles that introduce DNA into cells, such as liposomes. Additionally, techniques such as those described above may be used for the introduction of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene sequences into human cells.

Cells, preferably, autologous cells, containing 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expressing gene sequences may then be introduced or reintroduced into the subject at positions which allow for the amelioration of at least one symptom of a urological disorder. Such cell replacement techniques may be preferred, for example, when the gene product is a secreted, extracellular gene product.

Pharmaceutical Compositions

Another aspect of the invention pertains to methods for treating a subject suffering from a disease. These methods involve administering to a subject an agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity (e.g., an agent identified by a screening assay described herein), or a combination of such agents. In another embodiment, the method involves administering to a subject a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or nucleic acid molecule as therapy to compensate for reduced, aberrant, or unwanted 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 expression or activity.

Stimulation of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is desirable in situations in which 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 is abnormally downregulated and/or in which increased 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is likely to have a beneficial effect. Likewise, inhibition of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is desirable in situations in which 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 is abnormally upregulated and/or in which decreased 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity is likely to have a beneficial effect.

The agents which modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity can be administered to a subject using pharmaceutical compositions suitable for such administration. Such compositions typically comprise the agent (e.g., nucleic acid molecule, protein, or antibody) and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

A pharmaceutical composition used in the therapeutic methods of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the agent that modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity (e.g., a fragment of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or an anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The agents that modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity can also be prepared in the form of suppositories (e.g., with conventional suppository bases such as cocoa butter and other glycerides) or retention enemas for rectal delivery.

In one embodiment, the agents that modulate 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the agent that modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity and the particular therapeutic effect to be achieved, and the limitations inherent in the art of compounding such an agent for the treatment of subjects.

Toxicity and therapeutic efficacy of such agents can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and can be expressed as the ratio LD50/ED50. Agents which exhibit large therapeutic indices are preferred. While agents that exhibit toxic side effects may be used, care should be taken to design a delivery system that targets such agents to the site of affected tissue in order to minimize potential damage to uninfected cells and, thereby, reduce side effects.

The data obtained from the cell culture assays and animal studies can be used in formulating a range of dosage for use in humans. The dosage of such 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulating agents lies preferably within a range of circulating concentrations that include the ED50 with little or no toxicity. The dosage may vary within this range depending upon the dosage form employed and the route of administration utilized. For any agent used in the therapeutic methods of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of protein or polypeptide (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight. The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody can include a single treatment or, preferably, can include a series of treatments.

In a preferred example, a subject is treated with antibody, protein, or polypeptide in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks. It will also be appreciated that the effective dosage of antibody, protein, or polypeptide used for treatment may increase or decrease over the course of a particular treatment. Changes in dosage may result and become apparent from the results of diagnostic assays as described herein.

The present invention encompasses agents which modulate expression or activity. An agent may, for example, be a small molecule. For example, such small molecules include, but are not limited to, peptides, peptidomimetics, amino acids, amino acid analogs, polynucleotides, polynucleotide analogs, nucleotides, nucleotide analogs, organic or inorganic compounds (i.e,. including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds. It is understood that appropriate doses of small molecule agents depends upon a number of factors within the ken of the ordinarily skilled physician, veterinarian, or researcher. The dose(s) of the small molecule will vary, for example, depending upon the identity, size, and condition of the subject or sample being treated, further depending upon the route by which the composition is to be administered, if applicable, and the effect which the practitioner desires the small molecule to have upon the nucleic acid or polypeptide of the invention.

Exemplary doses include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram). It is furthermore understood that appropriate doses of a small molecule depend upon the potency of the small molecule with respect to the expression or activity to be modulated. Such appropriate doses may be determined using the assays described herein. When one or more of these small molecules is to be administered to an animal (e.g., a human) in order to modulate expression or activity of a polypeptide or nucleic acid of the invention, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

Further, an antibody (or fragment thereof) may be conjugated to a therapeutic moiety such as a cytotoxin, a therapeutic agent or a radioactive metal ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

The conjugates of the invention can be used for modifying a given biological response, the drug moiety is not to be construed as limited to classical chemical therapeutic agents. For example, the drug moiety may be a protein or polypeptide possessing a desired biological activity. Such proteins may include, for example, a toxin such as abrin, ricin A, pseudomonas exotoxin, or diphtheria toxin; a protein such as tumor necrosis factor, alpha-interferon, beta-interferon, nerve growth factor, platelet derived growth factor, tissue plasminogen activator; or biological response modifiers such as, for example, lymphokines, interleukin-1 ("IL-1"), interleukin-2 ("IL-2"), interleukin-6 ("IL-6"), granulocyte macrophase colony stimulating factor ("GM-CSF"), granulocyte colony stimulating factor ("G-CSF"), or other growth factors.

Techniques for conjugating such therapeutic moiety to antibodies are well known, see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62:119-58 (1982). Alternatively, an antibody can be conjugated to a second antibody to form an antibody heteroconjugate as described by Segal in U.S. Pat. No. 4,676,980.

The nucleic acid molecules used in the methods of the invention can be inserted into vectors and used as gene therapy vectors. Gene therapy vectors can be delivered to a subject by, for example, intravenous injection, local administration (see U.S. Pat. No. 5,328,470) or by stereotactic injection (see, e.g., Chen et al. (1994) *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

Pharmacogenomics

In conjunction with the therapeutic methods of the invention, pharmacogenomics (i.e., the study of the relationship between a subject's genotype and that subject's response to a foreign compound or drug) may be considered. Differences in metabolism of therapeutics can lead to severe toxicity or therapeutic failure by altering the relation between dose and blood concentration of the pharmacologically active drug. Thus, a physician or clinician may consider applying knowledge obtained in relevant pharmacogenomics studies in determining whether to administer an agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity, as well as tailoring the dosage and/or therapeutic regimen of treatment with an agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity.

Pharmacogenomics deals with clinically significant hereditary variations in the response to drugs due to altered drug disposition and abnormal action in affected persons. See, for example, Eichelbaum, M. et al. (1996) *Clin. Exp. Pharmacol. Physiol.* 23(10-11): 983-985 and Linder, M. W. et al. (1997) *Clin. Chem.* 43(2):254-266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare genetic defects or as naturally-occurring polymorphisms. For example, glucose-6-phosphate aminopeptidase deficiency (G6PD) is a common inherited enzymopathy in which the main clinical complication is haemolysis after ingestion of oxidant drugs (anti-malarials, sulfonamides, analgesics, nitrofurans) and consumption of fava beans.

One pharmacogenomics approach to identifying genes that predict drug response, known as "a genome-wide association", relies primarily on a high-resolution map of the human genome consisting of already known gene-related markers (e.g., a "bi-allelic" gene marker map which consists of 60,000-100,000 polymorphic or variable sites on the human genome, each of which has two variants). Such a high-resolution genetic map can be compared to a map of the genome of each of a statistically significant number of patients taking part in a Phase II/III drug trial to identify markers associated with a particular observed drug response or side effect. Alternatively, such a high resolution map can be generated from a combination of some ten million known single nucleotide polymorphisms (SNPs) in the human genome. As used herein, a "SNP" is a common alteration that occurs in a single nucleotide base in a stretch of DNA. For example, a SNP may occur once per every 1000 bases of DNA. A SNP may be involved in a disease process, however, the vast majority may not be disease-associated. Given a genetic map based on the occurrence of such SNPs, individuals can be grouped into genetic categories depending on a particular pattern of SNPs in their individual genome. In such a manner, treatment regimens can be tailored to groups of genetically similar individuals, taking into account traits that may be common among such genetically similar individuals.

Alternatively, a method termed the "candidate gene approach" can be utilized to identify genes that predict drug response. According to this method, if a gene that encodes a drug target is known (e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein used in the methods of the present invention), all common variants of that gene can be fairly easily identified in the population and it can be determined if having one version of the gene versus another is associated with a particular drug response.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and the cytochrome P450 enzymes CYP2D6 and CYP2C19) has provided an explanation as to why some patients do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, PM show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Alternatively, a method termed the "gene expression profiling" can be utilized to identify genes that predict drug response. For example, the gene expression of an animal dosed with a drug (e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 molecule or 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 modulator used in the methods of the present invention) can give an indication whether gene pathways related to toxicity have been turned on.

Information generated from more than one of the above pharmacogenomics approaches can be used to determine appropriate dosage and treatment regimens for prophylactic or therapeutic treatment of a subject. This knowledge, when applied to dosing or drug selection, can avoid adverse reactions or therapeutic failure and, thus, enhance therapeutic or prophylactic efficiency when treating a subject suffering from a urological disease, e.g., BPH, with an agent which modulates 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity.

Recombinant Expression Vectors and Host Cells Used in the Methods of the Invention The methods of the invention (e.g., the screening assays described herein) include the use of vectors, preferably expression vectors, containing a nucleic acid encoding a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked.

Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors to be used in the methods of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel (1990) *Methods Enzymol.* 185:3-7. Regulatory sequences include those which direct constitutive expression of a nucleotide sequence in many types of host cells and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the invention can be introduced into host cells to thereby produce proteins or peptides, including fusion proteins or peptides, encoded by nucleic acids as described herein (e.g., 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins, mutant forms of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins, fusion proteins, and the like).

The recombinant expression vectors to be used in the methods of the invention can be designed for expression of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins in prokaryotic or eukaryotic cells. For example, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins can be expressed in bacterial cells such as *E. coli*, insect cells (using baculovirus expression vectors), yeast cells, or mammalian cells. Suitable host cells are discussed further in Goeddel (1990) supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Purified fusion proteins can be utilized in 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity assays, (e.g., direct assays or competitive assays described in detail below), or to generate antibodies specific for 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins. In a preferred embodiment, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion protein expressed in a retroviral expression vector of the present invention can be utilized to infect bone marrow cells which are subsequently transplanted into irradiated recipients. The pathology of the subject recipient is then examined after sufficient time has passed (e.g., six weeks).

In another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J. et al., *Molecular Cloning: A Laboratory Manual. 2nd ed., Cold Spring Harbor Laboratory,* Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid).

The methods of the invention may further use a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific, or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using antisense genes, see Weintraub, H. et al., Antisense RNA as a molecular tool for genetic analysis, *Reviews—Trends in Genetics,* Vol. 1(1) 1986.

Another aspect of the invention pertains to the use of host cells into which a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecule of the invention is introduced, e.g., a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecule within a recombinant expression vector or a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecule containing sequences which allow it to homologously recombine into a specific site of the host cell's genome. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be expressed in bacterial cells such as *E. coli,* insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook et al. (*Molecular Cloning: A Laboratory Manual. 2nd, ed., Cold Spring Harbor Laboratory,* Cold Spring Harbor Laboratory Press, Cold Spring Harbor, N.Y., 1989), and other laboratory manuals.

A host cell used in the methods of the invention, such as a prokaryotic or eukaryotic host cell in culture, can be used to produce (i.e., express) a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Accordingly, the invention further provides methods for producing a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein using the host cells of the invention. In one embodiment, the method comprises culturing the host cell of the invention (into which a recombinant expression vector encoding a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein has been introduced) in a suitable medium such that a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein is produced. In another embodiment, the method further comprises isolating a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein from the medium or the host cell.

Isolated Nucleic Acid Molecules Used in the Methods of the Invention

The methods of the invention include the use of isolated nucleic acid molecules that encode 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins or biologically active portions thereof, as well as nucleic acid fragments sufficient for use as hybridization probes to identify 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-encoding nucleic acid molecules (e.g., 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA) and fragments for use as PCR primers for the amplification or mutation of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

A nucleic acid molecule used in the methods of the present invention, e.g., a nucleic acid molecule having the nucleotide sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, or a portion thereof, can be isolated using standard molecular biology techniques and the sequence information provided herein. Using all or portion of the nucleic acid sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 as a hybridization probe, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecules can be isolated using standard hybridization and cloning techniques (e.g., as described in Sambrook, J., Fritsh, E. F., and Maniatis, T. *Molecular Cloning: A Laboratory Manual. 2nd, ed., Cold Spring Harbor Laboratory,* Cold Spring Harbor Laboratory Press, Cold Spring Harbor, N.Y., 1989).

Moreover, a nucleic acid molecule encompassing all or a portion of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 can be isolated by the polymerase chain reaction (PCR) using synthetic oligonucleotide primers designed based upon the sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135.

A nucleic acid used in the methods of the invention can be amplified using cDNA, mRNA or, alternatively, genomic DNA as a template and appropriate oligonucleotide primers according to standard PCR amplification techniques. Furthermore, oligonucleotides corresponding to 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleotide sequences can be prepared by standard synthetic techniques, e.g., using an automated DNA synthesizer.

In a preferred embodiment, the isolated nucleic acid molecules used in the methods of the invention comprise the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, a complement of the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, or aportion of any of these nucleotide sequences. A nucleic acid molecule which is complementary to the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 is one which is sufficiently complementary to the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 such that it can hybridize to the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 thereby forming a stable duplex.

In still another preferred embodiment, an isolated nucleic acid molecule used in the methods of the present invention comprises a nucleotide sequence which is at least about 55%, 60%, 65%, 70%, 75%, 80%, 85%, 90%, 95%, 96%, 97%, 98%, 99% or more identical to the entire length of the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, ora portion of any of this nucleotide sequence.

Moreover, the nucleic acid molecules used in the methods of the invention can comprise only a portion of the nucleic acid sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, for example, a fragment which can be used as a probe or primer or a fragment encoding a portion of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, e.g., a biologically active portion of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. The probe/primer typically comprises substantially purified oligonucleotide. The oligonucleotide typically comprises a region of nucleotide sequence that hybridizes under stringent conditions to at least about 12 or 15, preferably about 20 or 25, more preferably about 30, 35, 40, 45, 50, 55, 60, 65, or 75 consecutive nucleotides of a sense sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, of an anti-sense sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, or of a naturally occurring allelic variant or mutant of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135. In one embodiment, a nucleic acid molecule used in the methods of the present invention comprises a nucleotide sequence which is greater than 100, 100-200, 200-300, 300-400, 400-500, 500-600, 600-700, 700-800, 800-900, 900-1000, 1000-1100, 1100-1200, 1200-1300, or more nucleotides in length and hybridizes under stringent hybridization conditions to a nucleic acid molecule of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135.

As used herein, the term "hybridizes under stringent conditions" is intended to describe conditions for hybridization and washing under which nucleotide sequences that are significantly identical or homologous to each other remain hybridized to each other. Preferably, the conditions are such that sequences at least about 70%, more preferably at least about 80%, even more preferably at least about 85% or 90% identical to each other remain hybridized to each other. Such stringent conditions are known to those skilled in the art and can be found in *Current Protocols in Molecular Biology*, Ausubel et al., eds., John Wiley & Sons, Inc. (1995), sections 2, 4 and 6. Additional stringent conditions can be found in *Molecular Cloning: A Laboratory Manual*, Sambrook et al., Cold Spring Harbor Press, Cold Spring Harbor, N.Y. (1989), chapters 7, 9 and 11. A preferred, non-limiting example of stringent hybridization conditions includes hybridization in 4× sodium chloride/sodium citrate (SSC), at about 65-70° C. (or hybridization in 4×SSC plus 50% formamide at about 42-50° C.) followed by one or more washes in 1×SSC, at about 65-70° C. A preferred, non-limiting example of highly stringent hybridization conditions includes hybridization in 1×SSC, at about 65-70° C. (or hybridization in 1×SSC plus 50% formamide at about 42-50° C.) followed by one or more washes in 0.3×SSC, at about 65-70° C. A preferred, non-limiting example of reduced stringency hybridization conditions includes hybridization in 4×SSC, at about 50-60° C. (or alternatively hybridization in 6×SSC plus 50% formamide at about 40-45° C.) followed by one or more washes in 2×SSC, at about 50-60° C. Ranges intermediate to the above-recited values, e.g., at 65-70° C. or at 42-50° C. are also intended to be encompassed by the present invention. SSPE (1×SSPE is 0.15M NaCl, 10 mM NaH$_2$PO$_4$, and 1.25 mM EDTA, pH 7.4) can be substituted for SSC (1×SSC is 0.15M NaCl and 15 mM sodium citrate) in the hybridization and wash buffers; washes are performed for 15 minutes each after hybridization is complete. The hybridization temperature for hybrids anticipated to be less than 50 base pairs in length should be 5-10° C. less than the melting temperature ($T_m$) of the hybrid, where $T_m$ is determined according to the following equations. For hybrids less than 18 base pairs in length, $T_m$(° C.)=2(# of A+T bases)+4(# of G+C bases). For hybrids between 18 and 49 base pairs in length, $T_m$(° C.)=81.5+16.6 (log$_{10}$[Na$^+$])+0.41(% G+C)−(600/N), where N is the number of bases in the hybrid, and [Na$^+$] is the concentration of sodium ions in the hybridization buffer ([Na$^+$] for 1×SSC=0.165 M). It will also be recognized by the skilled practitioner that additional reagents may be added to hybridization and/or wash buffers to decrease non-specific hybridization of nucleic acid molecules to membranes, for example, nitrocellulose or nylon membranes, including but not limited to blocking agents (e.g., BSA or salmon or herring sperm carrier DNA), detergents (e.g., SDS), chelating agents (e.g., EDTA), Ficoll, PVP and the like. When using nylon membranes, in particular, an additional preferred, non-limiting example of stringent hybridization conditions is hybridization in 0.25-0.5M NaH$_2$PO$_4$, 7% SDS at about 65° C., followed by one or more washes at 0.02M NaH$_2$PO$_4$, 1% SDS at 65° C., see e.g., Church and Gilbert (1984) *Proc. Natl. Acad. Sci. USA* 81:1991-1995, (or alternatively 0.2×SSC, 1% SDS).

In preferred embodiments, the probe further comprises a label group attached thereto, e.g., the label group can be a radioisotope, a fluorescent compound, an enzyme, or an enzyme co-factor. Such probes can be used as a part of a diagnostic test kit for identifying cells or tissue which misexpress a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, such as by measuring a level of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-encoding nucleic acid in a sample of cells from a subject e.g., detecting 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA levels or determining whether a genomic 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene has been mutated or deleted.

The methods of the invention further encompass the use of nucleic acid molecules that differ from the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 due to degeneracy of the genetic code and thus encode the same 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins as those encoded by the nucleotide sequence shown in SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135. In another embodiment, an isolated nucleic acid molecule included in the methods of the invention has a nucleotide sequence encoding a protein having an amino acid sequence shown in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136.

The methods of the invention further include the use of allelic variants of human 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053, e.g., functional and non-functional allelic variants. Functional allelic variants are naturally occurring amino acid sequence variants of the human 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein that maintain a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. Functional allelic variants will typically contain only conservative substitution of one or more amino acids of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136, or substitution, deletion or insertion of non-critical residues in non-critical regions of the protein.

Non-functional allelic variants are naturally occurring amino acid sequence variants of the human 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein that do not have a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. Non-functional allelic variants will typically contain a non-conservative substitution, deletion, or insertion or premature truncation of the amino acid sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136, or a substitution, insertion or deletion in critical residues or critical regions of the protein.

The methods of the present invention may further use non-human orthologues of the human 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Orthologues of the human 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein are proteins that are isolated from non-human organisms and possess the same 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity.

The methods of the present invention further include the use of nucleic acid molecules comprising the nucleotide sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 or a portion thereof, in which a mutation has been introduced. The mutation may lead to amino acid substitutions at "non-essential" amino acid residues or at "essential" amino acid residues. A "non-essential" amino acid residue is a residue that can be altered from the wild-type sequence of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 (e.g., the sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136) without altering the biological activity, whereas an "essential" amino acid residue is required for biological activity. For example, amino acid residues that are conserved among the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins of the present invention are not likely to be amenable to alteration.

Mutations can be introduced into SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135 by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., asparagine, glutamine, serine, threonine, tyrosine, cysteine), nonpolar side chains (e.g., glycine, alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein is preferably replaced with another amino acid residue from the same side chain family. Alternatively, in another embodiment, mutations can be introduced randomly along all or part of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 coding sequence, such as by saturation mutagenesis, and the resultant mutants can be screened for 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 biological activity to identify mutants that retain activity. Following mutagenesis of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135, the encoded protein can be expressed recombinantly and the activity of the protein can be determined using the assay described herein.

Another aspect of the invention pertains to the use of isolated nucleic acid molecules which are antisense to the nucleotide sequence of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133 or 135. An "antisense" nucleic acid comprises a nucleotide sequence which is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 coding strand, or to only a portion thereof. In one embodiment, an antisense nucleic acid molecule is antisense to a "coding region" of the coding strand of a nucleotide sequence encoding a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053. The term "coding region" refers to the region of the nucleotide sequence comprising codons which are translated into amino acid residues. In another embodiment, the antisense nucleic acid molecule is antisense to a "noncoding region" of the coding strand of a nucleotide sequence encoding 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053. The term "noncoding region" refers to 5' and 3' sequences which flank the coding region that are not translated into amino acids (also referred to as 5' and 3' untranslated regions).

Given the coding strand sequences encoding 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 disclosed herein, antisense nucleic acids of the invention can be designed according to the rules of Watson and Crick base pairing. The antisense nucleic acid molecule can be complementary to the entire coding region of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA, but more preferably is an oligonucleotide which is antisense to only a portion of the coding or noncoding region of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA. For example, the antisense oligonucleotide can be complementary to the region surrounding the translation start site of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 mRNA. An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest). Antisense nucleic acid molecules used in the methods of the invention are further described above, in section IV.

In yet another embodiment, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecules used in the methods of the present invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acids (see Hyrup B. et al. (1996) Bioorganic & Medicinal Chemistry 4 (1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup B. et al. (1996) supra; Perry-O'Keefe et al. (1996) Proc. Natl. Acad. Sci. 93:14670-675.

PNAs of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecules can be used in the therapeutic and diagnostic applications described herein. For example, PNAs can be used as antisense or antigene agents for sequence-specific modulation of gene expression by, for example, inducing transcription or translation arrest or inhibiting replication. PNAs of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecules can also be used in the analysis of single base pair mutations in a gene, (e.g., by PNA-directed PCR clamping); as 'artificial restriction enzymes' when used in combination with other enzymes, (e.g., S1 nucleases (Hyrup B. et al. (1996) supra)); or as probes or primers for DNA sequencing or hybridization (Hyrup B. et al. (1996) supra; Perry-O'Keefe et al. (1996) supra).

In another embodiment, PNAs of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be modified, (e.g., to enhance their stability or cellular uptake), by attaching lipophilic or other helper groups to PNA, by the formation of PNA-DNA chimeras, or by the use of liposomes or other techniques of drug delivery known in the art. For example, PNA-DNA chimeras of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 nucleic acid molecules can be generated which may combine the advantageous properties of PNA and DNA. Such chimeras allow DNA recognition enzymes, (e.g., RNAse H and DNA polymerases), to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup B. et al. (1996) supra). The synthesis of PNA-DNA chimeras can be performed as described in Hyrup B. et al. (1996) supra and Finn P. J. et al. (1996) Nucleic Acids Res. 24 (17): 3357-63. For example, a DNA chain can be synthesized on a solid support using standard phosphoramidite coupling chemistry and modified nucleoside analogs, e.g., 5'-(4-methoxytrityl)amino-5'-deoxy-thymidine phosphoramidite, can be used as a between the PNA and the 5' end of DNA (Mag, M. et al. (1989) Nucleic Acid Res. 17: 5973-88). PNA monomers are then coupled in a stepwise manner to produce a chimeric molecule with a 5' PNA segment and a 3' DNA segment (Finn P. J. et al. (1996) supra). Alternatively, chimeric molecules can be synthesized with a 5' DNA segment and a 3' PNA segment (Peterser, K. H. et al. (1975) Bioorganic Med. Chem. Lett. 5: 1119-11124).

In other embodiments, the oligonucleotide used in the methods of the invention may include other appended groups such as peptides (e.g., for targeting host cell receptors in vivo), or agents facilitating transport across the cell membrane (see, e.g., Letsinger et al. (1989) Proc. Natl.

Acad. Sci. USA 86:6553-6556; Lemaitre et al. (1987) Proc. Natl. Acad. Sci. USA 84:648-652; PCT Publication No. WO88/09810) or the blood-brain barrier (see, e.g., PCT Publication No. WO89/10134). In addition, oligonucleotides can be modified with hybridization-triggered cleavage agents (See, e.g., Krol et al. (1988) Bio-Techniques 6:958-976) or intercalating agents. (See, e.g., Zon (1988) Pharm. Res. 5:539-549). To this end, the oligonucleotide may be conjugated to another molecule, (e.g., a peptide, hybridization triggered cross-linking agent, transport agent, or hybridization-triggered cleavage agent).

Isolated 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 Proteins and Anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 Antibodies Used in the Methods of the Invention The methods of the invention include the use of isolated 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins, and biologically active portions thereof, as well as polypeptide fragments suitable for use as immunogens to raise anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies. In one embodiment, native 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins can be isolated from cells or tissue sources by an appropriate purification scheme using standard protein purification techniques. In another embodiment, 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins are produced by recombinant DNA techniques. Alternative to recombinant expression, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or polypeptide can be synthesized chemically using standard peptide synthesis techniques.

As used herein, a "biologically active portion" of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein includes a fragment of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein having a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity. Biologically active portions of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein include peptides comprising amino acid sequences sufficiently identical to or derived from the amino acid sequence of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, e.g., the amino acid sequence shown in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136, which include fewer amino acids than the full length 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins, and exhibit at least one activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Typically, biologically active portions comprise a domain or motif with at least one activity of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein (e.g., the N-terminal region of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein that is believed to be involved in the regulation of apoptotic activity). A biologically active portion of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be a polypeptide which is, for example, 25, 50, 75, 100, 125, 150, 175, 200, 250, 300 or more amino acids in length. Biologically active portions of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be used as targets for developing agents which modulate a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 activity.

In a preferred embodiment, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein used in the methods of the invention has an amino acid sequence shown in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134or 136. In other embodiments, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein is substantially identical to SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136, and retains the functional activity of the protein of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136, yet differs in amino acid sequence due to natural allelic variation or mutagenesis, as described in detail in subsection V above. Accordingly, in another embodiment, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein used in the methods of the invention is a protein which comprises an amino acid sequence at least about 50%, 55%, 60%, 65%, 70%, 75%, 80%, 85%, 90%, 95%, 96%, 97%, 98%, 99%, or more identical to SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136.

To determine the percent identity of two amino acid sequences or of two nucleic acid sequences, the sequences are aligned for optimal comparison purposes (e.g., gaps can be introduced in one or both of a first and a second amino acid or nucleic acid sequence for optimal alignment and non-identical sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, or 90% of the length of the reference sequence (e.g., when aligning a second sequence to the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 amino acid sequence of SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136, having 500 amino acid residues, at least 75, preferably at least 150, more preferably at least 225, even more preferably at least 300, and even more preferably at least 400 or more amino acid residues are aligned). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch (*J. Mol. Biol.* 48:444-453 (1970)) algorithm which has been incorporated into the GAP program in the GCG software package, using either a Blosum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Meyers and W. Miller (*Comput. Appl. Biosci.* 4:11-17 (1988)) which has been incorporated into the ALIGN program (version 2.0 or 2.0U), using a PAM120 weight residue table, a gap length penalty of 12 and a gap penalty of 4.

The methods of the invention may also use 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 chimeric or fusion proteins. As used herein, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 "chimeric protein" or "fusion protein" comprises a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide operatively linked to a non-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide. An "44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide" refers to a polypeptide having an amino acid sequence corresponding to a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 molecule, whereas a "non-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide" refers to a polypeptide having an amino acid sequence corresponding to a protein which is not substantially homologous to the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, e.g., a protein which is different from the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein and which is derived from the same or a different organism. Within a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion protein the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide can correspond to all or a portion of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. In a preferred embodiment, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion protein comprises at least one biologically active portion of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. In another preferred embodiment, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion protein comprises at least two biologically active portions of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Within the fusion protein, the term "operatively linked" is intended to indicate that the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide and the non-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide are fused in-frame to each other. The non-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide can be fused to the N-terminus or C-terminus of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide.

For example, in one embodiment, the fusion protein is a GST-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion protein in which the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequences are fused to the C-terminus of the GST sequences. Such fusion proteins can facilitate the purification of recombinant 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053.

In another embodiment, this fusion protein is a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein containing a heterologous signal sequence at its N-terminus. In certain host cells (e.g., mammalian host cells), expression and/or secretion of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be increased through use of a heterologous signal sequence.

The 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion proteins used in the methods of the invention can be incorporated into pharmaceutical compositions and administered to a subject in vivo. The 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion proteins can be used to affect the bioavailability of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate. Use of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fusion proteins may be useful therapeutically for the treatment of disorders caused by, for example, (i) aberrant modification or mutation of a gene encoding a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein; (ii) mis-regulation of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 gene; and (iii) aberrant post-translational modification of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein.

Moreover, the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-fusion proteins used in the methods of the invention can be used as immunogens to produce anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies in a subject, to purify 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 ligands and in screening assays to identify molecules which inhibit the interaction of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 substrate.

Preferably, a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 chimeric or fusion protein used in the methods of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). A 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-encoding nucleic acid can be cloned into such an expression vector such that the fusion moiety is linked in-frame to the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein.

The present invention also pertains to the use of variants of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins which function as either 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 agonists (mimetics) or as 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antagonists. Variants of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins can be generated by mutagenesis, e.g., discrete point mutation or truncation of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. An agonist of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins can retain substantially the same, or a subset, of the biological activities of the naturally occurring form of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. An antagonist of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can inhibit one or more of the activities of the naturally occurring form of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein by, for example, competitively modulating a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053-mediated activity of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Thus, specific biological effects can be elicited by treatment with a variant of limited function. In one embodiment, treatment of a subject with a variant having a subset of the biological activities of the naturally occurring form of the protein has fewer side effects in a subject relative to treatment with the naturally occurring form of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein.

In one embodiment, variants of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein which function as either 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 agonists (mimetics) or as 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antagonists can be identified by screening combinatorial libraries of mutants, e.g., truncation mutants, of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein for 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein agonist or antagonist activity. In one embodiment, a variegated library of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 variants is generated by combinatorial mutagenesis at the nucleic acid level and is encoded by a variegated gene library. A variegated library of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 variants can be produced by, for example, enzymatically ligating a mixture of synthetic oligonucleotides into gene sequences such that a degenerate set of potential 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequences is expressible as individual polypeptides, or alternatively, as a set of larger fusion proteins (e.g., for phage display) containing the set of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequences therein. There are a variety of methods which can be used to produce libraries of potential 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477).

In addition, libraries of fragments of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein coding sequence can be used to generate a variegated population of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 fragments for screening and subsequent selection of variants of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. In one embodiment, a library of coding sequence fragments can be generated by treating a double stranded PCR fragment of a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 coding sequence with a nuclease under conditions wherein nicking occurs only once per molecule, denaturing the double stranded DNA, renaturing the DNA to form double stranded DNA which can include sense/antisense pairs from different nicked products, removing single stranded portions from reformed duplexes by treatment with SI nuclease, and ligating the resulting fragment library into an expression vector. By this method, an expression library can be derived which encodes N-terminal, C-terminal and internal fragments of various sizes of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 variants (Arkin and Yourvan (1992) *Proc. Natl. Acad. Sci. USA* 89:7811-7815; Delgrave et al. (1993) *Protein Engineering* 6(3):327-331).

The methods of the present invention further include the use of anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies. An isolated 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein, or a portion or fragment thereof, can be used as an immunogen to generate antibodies that bind 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 using standard techniques for polyclonal and monoclonal antibody preparation. A full-length 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein can be used or, alternatively, antigenic peptide fragments of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be used as immunogens. The antigenic peptide of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 comprises at least 8 amino acid residues of the amino acid sequence shown in SEQ ID NO:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134 or 136, and encompasses an epitope of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 such that an antibody raised against the peptide forms a specific immune complex with the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Preferably, the antigenic peptide comprises at least 10 amino acid residues, more preferably at least 15 amino acid residues, even more preferably at least 20 amino acid residues, and most preferably at least 30 amino acid residues.

Preferred epitopes encompassed by the antigenic peptide are regions of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 that are located on the surface of the protein, e.g., hydrophilic regions, as well as regions with high antigenicity.

A 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 immunogen is typically used to prepare antibodies by immunizing a suitable subject, (e.g., rabbit, goat, mouse, or other mammal) with the immunogen. An appropriate immunogenic preparation can contain, for example, recombinantly expressed 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein or a chemically synthesized 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 polypeptide. The preparation can further include an adjuvant, such as Freund's complete or incomplete adjuvant, or similar immunostimulatory agent. Immunization of a suitable subject with an immunogenic 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 preparation induces a polyclonal anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody response.

The term "antibody" as used herein refers to immunoglobulin molecules and immunologically active portions of immunoglobulin molecules, i.e., molecules that contain an antigen binding site which specifically binds (immunoreacts with) an antigen, such as a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053. Examples of immunologically active portions of immunoglobulin molecules include F(ab) and F(ab')$_2$ fragments which can be generated by treating the antibody with an enzyme such as pepsin. The invention provides polyclonal and monoclonal antibodies that bind 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 molecules. The term "monoclonal antibody" or "monoclonal antibody composition", as used herein, refers to a population of antibody molecules that contain only one species of an antigen binding site capable of immunoreacting with a particular epitope of 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053. A monoclonal antibody composition thus typically displays a single binding affinity for a particular 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein with which it immunoreacts.

Polyclonal anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies can be prepared as described above by immunizing a suitable subject with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 immunogen. The anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody titer in the immunized subject can be monitored over time by standard techniques, such as with an enzyme linked immunosorbent assay (ELISA) using immobilized 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053. If desired, the antibody molecules directed against 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 can be isolated from the mammal (e.g., from the blood) and further purified by well known techniques, such as protein A chromatography to obtain the IgG fraction. At an appropriate time after immunization, e.g., when the anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody titers are highest, antibody-producing cells can be obtained from the subject and used to prepare monoclonal antibodies by standard techniques, such as the hybridoma technique originally described by Kohler and Milstein (1975) *Nature* 256:495-497) (see also, Brown et al. (1981) *J. Immunol.* 127:539-46; Brown et al. (1980) *J. Biol. Chem.* 255:4980-83; Yeh et al. (1976) *Proc. Natl. Acad. Sci. USA* 76:2927-31; and Yeh et al. (1982) *Int. J. Cancer* 29:269-75), the more recent human B cell hybridoma technique (Kozbor et al. (1983) *Immunol Today* 4:72), the EBV-hybridoma technique (Cole et al. (1985) *Monoclonal Antibodies and Cancer Therapy*, Alan R. Liss, Inc., pp. 77-96) or trioma techniques. The technology for producing monoclonal antibody hybridomas is well known (see generally Kenneth, R. H. in *Monoclonal Antibodies: A New Dimension In Biological Analyses*, Plenum Publishing Corp., New York, N.Y. (1980); Lerner, E. A. (1981) *Yale J. Biol. Med.* 54:387-402; Gefter, M. L. et al. (1977) *Somatic Cell Genet.* 3:231-36). Briefly, an immortal cell line (typically a myeloma) is fused to lymphocytes (typically splenocytes) from a mammal immunized with a 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 immunogen as described above, and the culture supernatants of the resulting hybridoma cells are screened to identify a hybridoma producing a monoclonal antibody that binds 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053.

Any of the many well known protocols used for fusing lymphocytes and immortalized cell lines can be applied for the purpose of generating an anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 monoclonal antibody (see, e.g., G. Galfre et al. (1977) *Nature* 266:55052; Gefter et al. (1977) supra; Lerner (1981) supra; and Kenneth (1980) supra). Moreover, the ordinarily skilled worker will appreciate that there are many variations of such methods which also would be useful. Typically, the immortal cell line (e.g., a myeloma cell line) is derived from the same mammalian species as the lymphocytes. For example, murine hybridomas can be made by fusing lymphocytes from a mouse immunized with an immunogenic preparation of the present invention with an immortalized mouse cell line. Preferred immortal cell lines are mouse myeloma cell lines that are sensitive to culture medium containing hypoxanthine, aminopterin and thymidine ("HAT medium"). Any of a number of myeloma cell lines can be used as a fusion partner according to standard techniques, e.g., the P3-NS1/1-Ag4-1, P3-x63-Ag8.653 or Sp2/O-Ag14 myeloma lines. These myeloma lines are available from ATCC. Typically, HAT-sensitive mouse myeloma cells are fused to mouse splenocytes using polyethylene glycol ("PEG"). Hybridoma cells resulting from the fusion are then selected using HAT medium, which kills unfused and unproductively fused myeloma cells (unfused splenocytes die after several days because they are not transformed). Hybridoma cells producing a monoclonal antibody of the invention are detected by screening the hybridoma culture supernatants for antibodies that bind 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053, e.g., using a standard ELISA assay.

Alternative to preparing monoclonal antibody-secreting hybridomas, a monoclonal anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody can be identified and isolated by screening a recombinant combinatorial immunoglobulin library (e.g., an antibody phage display library) with 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 to thereby isolate immunoglobulin library members that bind 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053. Kits for generating and screening phage display libraries are commercially available (e.g., the Pharmacia *Recombinant Phage Antibody System*, Catalog No. 27-9400-01; and the Stratagene SurfZAP™ *Phage Display Kit*, Catalog No. 240612). Additionally, examples of methods and reagents particularly amenable for use in generating and screening antibody display library can be found in, for example, Ladner et al. U.S. Pat. No. 5,223,409; Kang et al. PCT International Publication No. WO 92/18619; Dower et al. PCT International Publication No. WO 91/17271; Winter et al. PCT International Publication WO 92/20791; Markland et al. PCT International Publication No. WO 92/15679; Breitling et al. PCT International Publication WO 93/01288; McCafferty et al. PCT International Publication No. WO 92/01047; Garrard et al. PCT International Publication No. WO 92/09690; Ladner et al. PCT International Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; Griffiths et al. (1993) *EMBO J* 12:725-734; Hawkins et al. (1992) *J. Mol. Biol.* 226:889-896; Clarkson et al. (1991) *Nature* 352:624-628; Gram et al. (1992) *Proc. Natl. Acad. Sci. USA* 89:3576-3580; Garrad et al. (1991) *Bio/Technology* 9:1373-1377; Hoogenboom et al. (1991) *Nuc. Acid Res.* 19:4133-4137; Barbas et al. (1991) *Proc. Natl. Acad. Sci. USA* 88:7978-7982; and McCafferty et al. (1990) *Nature* 348:552-554.

Additionally, recombinant anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies, such as chimeric and humanized monoclonal antibodies, comprising both human and non-human portions, which can be made using standard recombinant DNA techniques, are within the scope of the methods of the invention. Such chimeric and humanized monoclonal antibodies can be produced by recombinant DNA techniques known in the art, for example using methods described in Robinson et al. International Application No. PCT/US86/02269; Akira, et al. European Patent Application 184,187; Taniguchi, M., European Patent Application 171,496; Morrison et al. European Patent Application 173,494; Neuberger et al. PCT International Publication No. WO 86/01533; Cabilly et al. U.S. Pat. No. 4,816,567; Cabilly et al. European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Canc. Res.* 47:999-1005; Wood et al. (1985) *Nature* 314:446-449; Shaw et al. (1988) *J. Natl. Cancer Inst.* 80:1553-1544390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053; Morrison, S. L. (1985) *Science* 229:1202-1207; Oi et al. (1986) *BioTechniques* 4:214; Winter U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

An anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibody can be used to detect 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein (e.g., in a cellular lysate or cell supernatant) in order to evaluate the abundance and pattern of expression of the 44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 protein. Anti-44390, 54181, 211, 5687, 884, 1405, 636, 4421, 5410, 30905, 2045, 16405, 18560, 2047, 33751, 52872, 14063, 20739, 32544, 43239, 44373, 51164, 53010, 16852, 1587, 2207, 22245, 2387, 52908, 69112, 14990, 18547, 115, 579, 15985, 15625, 760, 18603, 2395, 2554, 8675, 32720, 4809, 14303, 16816, 17827, 32620, 577, 619, 1423, 2158, 8263, 15402, 16209, 16386, 21165, 30911, 41897, 1643, 2543, 9626, 13231, 32409, 84260, 2882, 8203, 32678 or 55053 antibodies can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, □-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^3H$.

This invention is further illustrated by the following examples which should not be construed as limiting. The contents of all references, patents and published patent applications cited throughout this application, as well as the Figure and the Sequence Listing is incorporated herein by reference.

EXAMPLES

Example 1

Tissure Distribution of Using Taqman™ Analysis

This example describes the TaqMan™ procedure. The Taqman™ procedure is a quantitative, reverse transcription PCR-based approach for detecting mRNA. The RT-PCR reaction exploits the 5' nuclease activity of AmpliTaq Gold™ DNA Polymerase to cleave a TaqMan™ probe during PCR. Briefly, cDNA was generated from the samples of interest, e.g., heart, kidney, liver, skeletal muscle, and various vessels, and used as the starting material for PCR amplification. In addition to the 5' and 3' gene-specific primers, a gene-specific oligonucleotide probe (complementary to the region being amplified) was included in the reaction (i.e., the Taqman™ probe). The TaqMan™ probe includes the oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxyfluorescein), or VIC) and a quencher dye (TAMRA (6-carboxy-N,N,N',N'-tetramethylrhodamine) at the 3' end of the probe. During the PCR reaction, cleavage of the probe separates the reporter dye and the quencher dye, resulting in increased fluorescence of the reporter. Accumulation of PCR products is detected directly by monitoring the increase in fluorescence of the reporter dye. When the probe is intact, the proximity of the reporter dye to the quencher dye results in suppression of the reporter fluorescence. During PCR, if the target of interest is present, the probe specifically anneals between the forward and reverse primer sites. The 5'-3' nucleolytic activity of the AmpliTaq™Gold DNA Polymerase cleaves the probe between the reporter and the quencher only if the probe hybridizes to the target. The probe fragments are then displaced from the target, and polymerization of the strand continues. The 3' end of the probe is blocked to prevent extension of the probe during PCR. This process occurs in every cycle and does not interfere with the exponential accumulation of product. RNA was prepared using the trizol method and treated with DNase to remove contaminating genomic DNA. cDNA was synthesized using standard techniques. Mock cDNA synthesis in the absence of reverse transcriptase resulted in samples with no detectable PCR amplification of the control gene confirms efficient removal of genomic DNA contamination.

Example 2

Tissue Distribution of Using in situ Analysis

For in situ analysis, various tissues, e.g., tissues obtained from normal colon, breast, lung, and ovarian normal tissue, as well as colon, breast, lung, and ovarian tumors, colon metastatic to the liver, and angiogenic tissues were first frozen on dry ice. Ten-micrometer-thick sections of the tissues were post-fixed with 4% formaldehyde in DEPC treated 1× phosphate-buffered saline at room temperature for 10 minutes before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 minutes, sections were rinsed in DEPC 2×SSC (1×SSC is 0.15M NaCl plus 0.015M sodium citrate). Tissue was then dehydrated through a series of ethanol washes, incubated in 100% chloroform for 5 minutes, and then rinsed in 100% ethanol for 1 minute and 95% ethanol for 1 minute and allowed to air dry.

Hybridizations were performed with $^{35}S$-radiolabeled (5×10$^7$ cpm/ml) cRNA probes. Probes were incubated in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1× Denhardt's solution, 50% formamide, 10% dextran sulfate, 100 mM dithiothreitol, 0.1% sodium dodecyl sulfate (SDS), and 0.1% sodium thiosulfate for 18 hours at 55° C.

After hybridization, slides were washed with 2×SSC. Sections were then sequentially incubated at 37° C. in TNE (a solution containing 10 mM Tris-HCl (pH 7.6), 500 mM NaCl, and 1 mM EDTA), for 10 minutes, in TNE with 10 μg of RNase A per ml for 30 minutes, and finally in TNE for 10 minutes. Slides were then rinsed with 2×SSC at room temperature, washed with 2×SSC at 50° C. for I hour, washed with 0.2×SSC at 55° C. for 1 hour, and 0.2×SSC at 60° C. for 1 hour. Sections were then dehydrated rapidly through serial ethanol-0.3 M sodium acetate concentrations before being air dried and exposed to Kodak Biomax MR scientific imaging film for 24 hours and subsequently dipped in NB-2 photoemulsion and exposed at 4° C. for 7 days before being developed and counter stained.

Equivalents

Those skilled in the art will recognize, or be able to ascertain using no more than routine experimentation, many equivalents to the specific embodiments of the invention described herein. Such equivalents are intended to be encompassed by the following claims.

SEQUENCE LISTING (136 sequences)

SEQ ID NO: 1 - DNA, 2043 bp, Homo sapiens
  CDS (17)...(1996)
cgcctgcaggtcggccatggccagtacggttagccccagcaccatagctgagaccccagagccacctccattgtctgaccacatccgaaatgctgctgacatctcagtcattgtcatctattttctggtggtgatggctgttgggctgtgggcgatgctgaagaccaaccgaggtactataggaggcttcttcctcgctggtcgtgatatggcctggtggccgatgggcgcctctctctttgccagtaacatcggcagcaaccactatgtggggctggctgggacaggagcagcttcaggagtcgccaccgtaacatttgaatggacttcctcagtaatgttgctgattcttgggtggatctttgtccctatctacatcaagtcgggggtgatgaccatgccggaatatctcaagaagcggtttggtggggagcgactccaggtctacctctccatcctctccctcttcatctgtgtggttttgttaatttctgcagacatatttgctggagccatattcatcaagctggccttgggattggacctttacctggcaatcttcatcctcttggctatgactgctgtttacaccaccactgggggcttggcctcggtgatttacacagacaccctccagaccatcatcatgctgattggctcttttattctcatggggtttgcatttaacgaagttggaggttatgagagctttaccgagaagtacgtgaatgccaccccatccgtagtcgagggggacaacttgacaatcagtgccagttgctacacacctcgggcggactccttccatatcttccgagatgctgtgactggggacattccatggccaggaattatatttggaatgcccattacagctttgtggtactggtgcacaaatcaggtcattgtgcagcgctgcctgtgtggcaaggacatgtctcacgtgaaggccgcttgcattatgtgtgcttacctgaagctgctgcccatgttcctcatggtgatgccggggatgatcagccgcatcctgtacacagatatggtagcatgtgtggtaccttctgaatgcgtgaaacactgtggcgttgatgttggctgcaccaactacgcataccccacgatggtgctggaactgatgccccaaggactgcgaggcctgatgctttcggtcatgctggcctctctcatgagctccctgacctccatcttcaacagcgccagcaccctcttcaccattgacctctacaccaagatgcggaagcaagcgtcggagaaagagctcctgatagctggacggatatttgttcttctattaactgttgtgagcattgtgtgggtcccactggtacaagtttctcaaaatggacaactaatccattacacagaatcaatttctagctaccttgggcctccaattgcagctgtctttgtgcttgccatcttctgtaaaagagtcaatgaacagggagcattctggggtctaatggttggacttgcaatgggcctcattcgtatgataacagagtttgcttatggaacagggagttgcttggctcccagtaactgtcccaagattatctgtggagtgcactatctgtacttttccatcgttctcttttttgggtccatgctggtcaccctgggaatttccctcttaacaaaacccattcctgatgtacatctgtaccgcctgtgctgggttcttcggaacagtacagaggagcgaatcgatatagatgcagaagagaaaagtcaggaagaaacagatgatggtgttgaagaagattatcctgagaaatcacgtggatgcctcaagaaagcttatgacttgttctgcggtttgcagaagggacccaagctaaccaaggaggaggaggaagccttgagcaagaagctcacagacacgtctgagaggccctcgtggaggacaatagtgaacatcaacgccatcctcctcctggctgtggtggtctttattcacggctactatgcctgaactctatctgagccattagaataatgaataattcttaaaaaaaaaaa

SEQ ID NO: 2 - protein, 659 aa, Homo sapiens
MASTVSPSTIAETPEPPPLSDHIRNAADISVIVIYFLVVMAVGLWAMLKTNRGTIGGFFLAGRDMAWWPMGASLFASNIGSNHYVGLAGTGAASGVATVTFEWTSSVMLLILGWIFVPIYIKSGVMTMPEYLKKRFGGERLQVYLSILSLFICVVLLISADIFAGAIFIKLALGLDLYLAIFILLAMTAVYTTTGGLASVIYTDTLQTIIMLIGSFILMGFAFNEVGGYESFTEKYVNATPSVVEGDNLTISASCYTPRADSFHIFRDAVTGDIPWPGIIFGMPITALWYWCTNQVIVQRCLCGKDMSHVKAACIMCAYLKLLPMFLMVMPGMISRILYTDMVACVVPSECVKHCGVDVGCTNYAYPTMVLELMPQGLRGLMLSVMLASLMSSLTSIFNSASTLFTIDLYTKMRKQASEKELLIAGRIFVLLLTVVSIVWVPLVQVSQNGQLIHYTESISSYLGPPIAAVFVLAIFCKRVNEQGAFWGLMVGLAMGLIRMITEFAYGTGSCLAPSNCPKIICGVHYLYFSIVLFFGSMLVTLGISLLTKPIPDVHLYRLCWVLRNSTEERIDIDAEEKSQEETDDGVEEDYPEKSRGCLKKAYDLFCGLQKGPKLTKEEEEALSKKLTDTSERPSWRTIVNINAILLLAVVVFIHGYYA

SEQ ID NO: 3 - DNA, 3183 bp, Homo sapiens
  CDS (42)...(2036)
gagtgttggggttggcggccacagctaagtccaacaccagcatgtcgctgcagagaatcgtgcgtgtgtccctggagcatcccaccagcgcggtgtgtgtggctggcgtggagaccctcgtggacatttatgggtcagtgcctgagggcacagaaatgtttgaggtctatgggacgcctggcgtggacatctacatctctcccaacatggagaggggccgggagcgtgcagacaccaggcggtggcgctttgacgcgactttggagatcatcgtggtcatgaactcccccagcaatgacctcaacgacagccatgttcagatttcctaccactccagccatgagcctctgcccctagcctatgcggtgctctacctcacctgtgttgacatctctctggattgcgacctgaactgtgagggaaggcaggacaggaactttgtagacaagcggcagtgggtctgggggcccagtgggtatggcggcatcttgctggtgaactgtgaccgtgatgatccgagctgtgatgtccaggacaattgtgaccagcacgtgcactgcctgcaagacctggaagacatgtctgtcatggtcctgcggacgcagggccctgcagccctctttgatgaccacaaacttgtcctccatacctccagctatgatgccaaacgggcacaggtcttccacatctgcggtcctgaggatgtgtgtgaggcctataggcatgtgctgggccaagataaggtgtcctatgaggtaccccgcttgcatggggatgaggagcgcttcttcgtggaaggcctgtccttccctgatgccggcttcacaggactcatctccttccatgtcactctgctggacgactccaacgaggatttctcggcatcccctatcttcactgacactgtggtgttccgagtggcaccctggatcatgacgcccagcactctgccacccctagaggtgtatgtgtgccgtgtgaggaacaacacgtgttttgtggatgcggtggcagagctggccaggaaggccggctgcaagctgaccatctgcccacaggccgagaaccgcaacgaccgctggatccaggatgagatggagctgggctacgttcaggcgccgcacaagaccctcccggtggtctttgactccccaaggaatggggaactgcaggatttcccttacaaaagaatcctgggtccagattttggttacgtgactcgggaaccacgcgacaggtctgtgagtggcctggactcctttgggaacctggaggtcagccctccagtggtggccaatgggaaagagtaccccctggggaggatcctcattgggggcaacctgcctgggtcaagtggccgcagggtcacccaggtggtgcgggacttcctccatgcccagaaggtgcagccccccgtggagctctttgtggactggttggccgtgggccatgtggatgagtttctgagctttgtccctgtccccgatgggaagggcttccggatgctcctggccagccctggggcctgcttcaagctcttccaggaaaagcagaagtgtggccacgggagggccctcctgttccagggggttgttgatgatgagcaggtcaagaccatctccatcaaccaggtgctctccaataaagacctcatcaactacaataagtttgtgcagagctgcatcgactggaaccgtgaggtgctgaagcgggagctgggcctggcagagtgtgacatcattgacatcccacagctcttcaagaccgagaggaaaaaagcaacggccttcttccctgacttggtgaacatgctggtgctggggaagcacctgggcatccccaagccctttgggcccatcatcaatggctgctgctgcctggaggagaaggtgcggtccctgctggagcctctgggcctccactgcaccttcattgatgacttcactccataccacatgctgcatggggaggtgcactgtggcaccaatgtgtgcagaaagcccttctctttcaagtggtggaacatggtgccctgagacagctcccacccaccatcctgtccccctggggcgggcattggccaggtggtggagacagagacaggccctgaacgataagcaccaagagacccaaggctccagatggaacactgagggtgaccgtccctctcagaagcttttccctggagtgtcatgcctcacctgcaacccatgtggttctcagacttgaatcttctcggcccccaaaaatgaaggacctcatttcttatagcctctcctgtgattcaacacaacccatggagatgtccccttctcactctgaaatcatccatttggggacaaatccacattggggtctagaaacatccacgtatctcatcagccatcttgtcctgtgcatcctaacagaggaaggatccatgattctgctttggtccaattgcttcctctctgcagaggaacaaccccaaaaccagaccactccacgcaggacaggcaggagagattcttcctaaagcctcccccataaaaagggagctgtggatccacttagatcagggcggaaccatctttcacccggccaagctcctgcccagatgttgaccctcacccagcgtgagctttcacatagtaggagcttctagatgcatgtggaagcaatgagagttgtcccttagccttataaactccccatgatctgacatgcagaaatccagccttgtccagaatcctcctggaattgcttggaggacgaaagtatgctgggggatgggtgggtactagggagactgggtacaagggtgaaaagtagttcccataatacacatggttgactatggtgatccaccttgtgatggttaatattaggtgtctggagaaggttgcttcattggccctgggacttctctctgcaggaggagagaacgctgcctctcctctggattggtctcaggctctctgttggcctttggtcagcgtttccacatcctgctctgctgcaggagagggggctaaggggctggatccaccaaggcagctcacagcgggaaaactctgggactgaaccactgaattcaggggatgggggtgggggcccggttctcgaggtgtgtgccagctacacgtgtgttctgtatgggtccagctgcgtttccatcactcgctaataaatcaacagaaacac

SEQ ID NO: 4 - protein, 664 aa, Homo sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPVPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 5 - DNA, 1393 bp, Homo sapiens
  CDS (72)...(1358)
cattagaggaatgagccgggagtgagcaattcaccagctctccagcacttggtggaaagcagcaggcaaggatggatgtggttgacagccttcttgtgaatggaagcaacatcactcctccctgtgaactcgggctcgaaaatgagacgcttttctgcttggatcagccccgtccttccaaagagtggcagccagcggtgcagattctcttgtactccttgatattcctgctcagcgtgctgggaaacacgctggtcatcaccgtgctgattcggaacaagcggatgcggacggtcaccaacatcttcctcctctccctggctgtcagcgacctcatgctctgtctcttctgcatgccgttcaacctcatccccaatctgctcaaggatttcatcttcgggagcgccgtttgcaagaccaccacctacttcatgggcacctctgtgagtgtatctacctttaatctggtagccatatctctagagagatatggtgcgatttgcaaacccttacagtcccgggtctggcagacaaaatcccatgctttgaaggtgattgctgctacctggtgcctttcctttaccatcatgactccgtaccccatttatagcaacttggtgccttttaccaaaaataacaaccagaccgcgaatatgtgccgctttctactgccaaatgatgttatgcagcagtcctggcacacattcctgttactcatcctctttcttattcctggaattgtgatgatggtggcatatggattaatctctttggaactctaccagggaataaaatttgaggctagccagaagaagtctgctaaagaaaggaaacctagcaccaccagcagcggcaaatatgaggacagcgatgggtgttacctgcaaaagaccaggcccccgaggaagctggagctccggcagctgtccaccggcagcagcagcagggccaaccgcatccggagtaacagctccgcagccaacctgatggccaagaaaagggtgatccgcatgctcatcgtcatcgtggtcctcttcttcttgtgctggatgcccatcttcagcgccaacgcctggcgggcctacgacaccgcctccgcagagcgccgcctctcaggaacccccatttccttcatcctcctcctgtcctacacctcctcctgcgtcaaccccatcatctactgcttcatgaacaaacgcttccgcctcggcttcatggccaccttcccctgctgccccaatcctggtcccccaggggcgaggggagaggtgggggaggaggaggaaggcgggaccacaggagcctctctgtccaggttctcgtacagccatatgagtgcctcggtgccaccccagtgagatgtcccctgaccctccaccgcagaaggaaggca

SEQ ID NO: 6 - protein, 428 aa, Homo sapiens
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 7 - DNA, 1936 bp, Homo sapiens
  CDS (99)...(1667)
tctggagccaagtaatggtgatactgatgcttccttttctttgccgcgctcggattctgagtttcacaagaatgtacctgggtgccccttagcgggatatgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaaaaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttataccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaaaaaaaaaaaaaaaaaaaa

SEQ ID NO: 8 - protein, 522 aa, Homo sapiens
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYTLKAKSHVLINTSNQLVQESTFQNPHGETLLYRKSAEKPQQELVMEELKETTNSSEI

SEQ ID NO: 9 - DNA, 1715 bp, Homo sapiens
  CDS (297)...(1646)
cgggaggcaacagacacgctggagtttaacaaacagcaatactcttcgcgctcctgaaaagcaggtctggacgctctccgtggtgctgaaacgcctcgcagccgccgctgtccgtggtatctacgaccccctcgctccaatttcccctggggctctccctccgcgcccctgttccccgcctccctttaacatctggattattttttgcaatagcgctttctggttttgtaagtgccaatttgaaacattttttgcccccataactcgtggactacaaagcacaaaggacctgaaaaatgtacagcttcaatactcttcgactctacctttcgggagccattgtattcttcagccttgctgcttctaaggaggctgaagctgctcgctccgcaaccaagcctatgtcaccctcggatttcctggataagctaatggggagaacctccggatatgatgccaggatcaggcccaattttaaaggtcccccagtgaacgtgagctgcaacattttcatcaacagctttggttccattgctgagacaaccatggactatagggtcaacatcttcctgcggcagcaatggaacgacccccgcctggcctataatgaataccctgacgactctctggacctggacccatccatgctggactccatctggaaacctgacctgttctttgccaacgagaagggggcccacttccatgagatcaccacagacaacaaattgctaaggatctcccggaatgggaatgtcctctacagcatcagaatcaccctgacactggcctgccccatggacttgaagaatttccccatggatgtccagacatgtatcatgcaactggaaagctttggatatacgatgaatgacctcatctttgagtggcaggaacagggagccgtgcaggtagcagatggactaactctgccccagtttatcttgaaggaagagaaggacttgagatactgcaccaagcactacaacacaggtaaattcacctgcattgaggcccggttccacctggagcggcagatgggttactacctgattcagatgtatattcccagcctgctcattgtcatcctctcatggatctccttctggatcaacatggatgctgcacctgctcgtgtgggcctaggcatcaccactgtgctcaccatgaccacccagagctccggctctcgagcatctctgcccaaggtgtcctatgtgaaagccattgacatttggatggcagtttgcctgctctttgtgttctcagccctattagaatatgctgccgttaactttgtgtctcggcaacataaggagctgctccgattcaggaggaagcggagacatcacaaggaggatgaagctggagaaggccgctttaacttctctgcctatgggatgggcccagcctgtctacaggccaaggatggcatctcagtcaagggcgccaacaacagtaacaccaccaacccccctcctgcaccatctaagtccccagaggagatgcgaaaactcttcatccagagggccaagaagatcgacaaaatatcccgcattggcttccccatggccttcctcattttcaacatgttctactggatcatctacaagattgtccgtagagaggacgtccacaaccagtgaagggtctgaaaggttgggggaggctgggagaggggaacgtgggaatagcacaggaatctgagagacggt

SEQ ID NO: 10 - protein, 449 aa, Homo sapiens
MYSFNTLRLYLSGAIVFFSLAASKEAEAARSATKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 11 - DNA, 3621 bp, Homo sapiens
  CDS (74)...(3385)
cccacagggggaccggccctgtgacccctcaccggggccgtgggcccgagccccggacttccctaagccggcaatgaccgcctgcgcccgccgagcgggtgggcttccggaccccgggctctgcggtcccgcgtggtgggctccgtccctgccccgcctcccccgggccctgccccggctcccgctcctgctgctcctgcttctgctgcagccccccgccctctccgccgtgttcacggtgggggtcctgggcccctgggcttgcgaccccatcttctctcgggctcgcccggacctggccgcccgcctggccgccgcccgcctgaaccgcgaccccggcctggcaggcggtccccgcttcgaggtagcgctgctgcccgagccttgccggacgccgggctcgctgggggccgtgtcctccgcgctggcccgcgtgtcgggcctcgtgggtccggtgaaccctgcggcctgccggccagccgagctgctcgccgaagaagccgggatcgcgctggtgccctggggctgcccctggacgcaggcggagggcaccacggcccctgccgtgacccccgccgcggatgccctctacgccctgcttcgcgcattcggctgggcgcgcgtggccctggtcaccgccccccaggacctgtgggtggaggcgggacgctcactgtccacggcactcagggcccgggggctgcctgtcgcctccgtgacttccatggagcccttggacctgtctggagcccgggaggccctgaggaaggttcgggacgggcccagggtcacagcagtgatcatggtgatgcactcggtgctgctgggtggcgaggagcagcgctacctcctggaggccgcagaggagctgggcctgaccgatggctccctggtcttcctgcccttcgacacgatccactacgccttgtccccaggcccggaggccttggccgcactcgccaacagctcccagcttcgcagggcccacgatgccgtgctcaccctcacgcgccactgtccctctgaaggcagcgtgctggacagcctgcgcagggctcaagagcgccgcgagctgccctctgacctcaatctgcagcaggtctccccactctttggcaccatctatgacgcggtcttcttgctggcaaggggcgtggcagaagcgcgggctgccgcaggtggcagatgggtgtccggagcagctgtggcccgccacatccgggatgcgcaggtccctggcttctgcggggacctaggaggagacgaggagcccccattcgtgctgctagacacggacgcggcgggagaccggctttttgccacatacatgctggatcctgcccggggctccttcctctccgccggtacccggatgcacttcccgcgtgggggatcagcacccggacctgacccctcgtgctggttcgatccaaacaacatctgcggtggaggactggagccgggcctcgtctttcttggcttcctcctggtggttgggatggggctggctggggccttcctggcccattatgtgaggcaccggctacttcacatgcaaatggtctccggccccaacaagatcatcctgaccgtggacgacatcacctttctccacccacatgggggcacctctcgaaaggtggcccaggggagtcgatcaagtctgggtgcccgcagcatgtcagacattcgcagcggccccagccaacacttggacagccccaacattggtgtctatgagggagacagggtttggctgaagaaattcccaggggatcagcacatagctatccgcccagcaaccaagacggccttctccaagctccaggagctccggcatgagaacgtggccctctacctggggcttttcctggctcggggagcagaaggccctgcggccctctgggagggcaacctggctgtggtctcagagcactgcacgcggggctctcttcaggacctcctcgctcagagagaaataaagctggactggatgttcaagtcctccctcctgctggaccttatcaagggaataaggtatctgcaccatcgaggcgtggctcatgggcggctgaagtcacggaactgcatagtggatggcagattcgtactcaagatcactgaccacggccacgggagactgctggaagcacagaaggtgctaccggagcctcccagagcggaggaccagctgtggacagccccggagctgcttagggacccagccctggagcgccggggaacgctggccggcgacgtctttagcttggccatcatcatgcaagaagtagtgtgccgcagtgccccttatgccatgctggagctcactcccgaggaagtggtgcagagggtgcggagcccccctccactgtgtcggcccttggtgtccatggaccaggcacctgtcgagtgtatcctcctgatgaagcagtgctgggcagagcagccggaacttcggccctccatggaccacaccttcgacctgttcaagaacatcaacaagggccggaagacgaacatcattgactcgatgcttcggatgctggagcagtactctagtaacctggaggatctgatccgggagcgcacggaggagctggagctggaaaagcagaagacagaccggctgcttacacagatgctgcctccgtctgtggctgaggccttgaagacggggacaccagtggagcccgagtactttgagcaagtgacactgtactttagtgacattgtgggcttcaccaccatctctgccatgagtgagcccattgaggttgtggacctgctcaacgatctctacacactctttgatgccatcattggttcccacgatgtctacaaggtggagacaataggggacgcctatatggtggcctcggggctgccccagcggaatgggcagcgacacgcggcagagatcgccaacatgtcactggacatcctcagtgccgtgggcactttccgcatgcgccatatgcctgaggttcccgtgcgcatccgcataggcctgcactcgggtccatgcgtggcaggcgtggtgggcctcaccatgccgcggtactgcctgtttggggacacggtcaacaccgcctcgcgcatggagtccaccgggctgccttaccgcatccacgtgaacttgagcactgtggggattctccgtgctctggactcgggctaccaggtggagctgcgaggccgcacggagctgaagggcaagggcgccgaggacactttctggctagtgggcagacgcggcttcaacaagcccatccccaaaccgcctgacctgcaaccggggtccagcaaccacggcatcagcctgcaggagatcccacccgagcggcgacggaagctggagaaggcgcggccgggccagttctcttgagaagtgaggcccggccccggacagggtctgggccctgctccctgtcccatctgcagtggaccccaggcacccccctttgaggaggtggggtgaactgctccttggcagggatttgtgacactgcattgctgggctgtgttcctcgggctcttctggaccttgcaccgtggataccaggccatgtgccatggtatttgggtcctgggagggtgggtgaaataaaggcatactgtctt

SEQ ID NO: 12 - protein, 1103 aa, Homo sapiens
MTACARRAGGLPDPGLCGPAWWAPSLPRLPRALPRLPLLLLLLLLQPPALSAVFTVGVLGPWACDPIFSRARPDLAARLAAARLNRDPGLAGGPRFEVALLPEPCRTPGSLGAVSSALARVSGLVGPVNPAACRPAELLAEEAGIALVPWGCPWTQAEGTTAPAVTPAADALYALLRAFGWARVALVTAPQDLWVEAGRSLSTALRARGLPVASVTSMEPLDLSGAREALRKVRDGPRVTAVIMVMHSVLLGGEEQRYLLEAAEELGLTDGSLVFLPFDTIHYALSPGPEALAALANSSQLRRAHDAVLTLTRHCPSEGSVLDSLRRAQERRELPSDLNLQQVSPLFGTIYDAVFLLARGVAEARAAAGGRWVSGAAVARHIRDAQVPGFCGDLGGDEEPPFVLLDTDAAGDRLFATYMLDPARGSFLSAGTRMHFPRGGSAPGPDPSCWFDPNNICGGGLEPGLVFLGFLLVVGMGLAGAFLAHYVRHRLLHMQMVSGPNKIILTVDDITFLHPHGGTSRKVAQGSRSSLGARSMSDIRSGPSQHLDSPNIGVYEGDRVWLKKFPGDQHIAIRPATKTAFSKLQELRHENVALYLGLFLARGAEGPAALWEGNLAVVSEHCTRGSLQDLLAQREIKLDWMFKSSLLLDLIKGIRYLHHRGVAHGRLKSRNCIVDGRFVLKITDHGHGRLLEAQKVLPEPPRAEDQLWTAPELLRDPALERRGTLAGDVFSLAIIMQEVVCRSAPYAMLELTPEEVVQRVRSPPPLCRPLVSMDQAPVECILLMKQCWAEQPELRPSMDHTFDLFKNINKGRKTNIIDSMLRMLEQYSSNLEDLIRERTEELELEKQKTDRLLTQMLPPSVAEALKTGTPVEPEYFEQVTLYFSDIVGFTTISAMSEPIEVVDLLNDLYTLFDAIIGSHDVYKVETIGDAYMVASGLPQRNGQRHAAEIANMSLDILSAVGTFRMRHMPEVPVRIRIGLHSGPCVAGVVGLTMPRYCLFGDTVNTASRMESTGLPYRIHVNLSTVGILRALDSGYQVELRGRTELKGKGAEDTFWLVGRRGFNKPIPKPPDLQPGSSNHGISLQEIPPERRRKLEKARPGQFS

SEQ ID NO: 13 - DNA, 4234 bp, Homo sapiens
  CDS (863)...(2452)
aagcttactggtgaggcaagtgtgcgtctatttccatggcgccctggctcgcggcagcccctggctgggcgaggggtgtgatgtgggagtggggtgggagggggcagcaggcggggcctgccacgtcacttggagagtgtgtgttgggaaggaagggcagagcggagagccgagccgctgcagctgcggcggcggcagcgaagccttgagccgtggggaggtgggtccccggctcgggcgccggggcagccccgggcctctgcgaggcctgcggcgcggctcctagggaggaggtggcggctgtggcggccggaaccgcgaccttggccggacccagccccgcggtggacgcagggcggaggccgagccccgcaggagtctttgccgagccggaggaggcgcatctggcgcttcggtaccagcggcagccgggggtccggagcggctggaggagcgcagtggagaactgggaagagctagcccggctggagggcggacctctgcgtccgggagccggggtctcaaggcaccgctgggggcgaagcacggcgtcttttcgggcagccagtttcacacgcgcctgtgtgccggttccgggcatcccagtaagctctagcacccgggcgcgggtaacgggaagcgcagaaccaaatccccagcgcccaggtcacctccccagacccagccttgcagggaccagggctttagggctcacggacccaacggccaggtcagaccgcgaaccgggagagcgcggccccaccctaaagagggcgcacgggagctggggagcgggtgccgcgctccagagattgtgtcgtgggcgccgtcctagtggcggggagcgcacctccgagggggcatgagatcggagaaatcccttacgctggcggcgccgggggaggtccgtgggccggagggggagcaacaggatgcgggagacttcccggaggccggcgggggcgggggctgctgtagtagcgagcggctggtgatcaatatctccgggctgcgctttgagacacaattgcgcaccctgtcgctgtttccggacacgctgctcggagaccctggccggcgagtccgcttcttcgaccccctgaggaacgagtacttcttcgaccgcaaccggcccagcttcgacgccatcctctactactaccagtctgggggccgcctgcggaggccggtcaacgtgcccctggacattttcctggaggagatccgcttctaccagctgggggacgaggccctggcggccttccgggaggacgagggctgcctgcccgaaggtggcgaggacgagaagccgctgccctcccagcccttccagcgccaggtgtggctgctctttgagtacccagagagctctgggccggccaggggcatcgccatcgtctccgtgttggtcattctcatctccatagtcatcttttgcctggagaccttaccccagttccgtgtagatggtcgaggtggaaacaatggtggtgtgagtcgagtctccccagtttccagggggagtcaggaggaagaggaggatgaagacgattcctacacatttcatcatggcatcacccctggggaaatggggaccgggggctcctcctcactcagtactcttgggggctccttctttacagaccccttctttctggtggagacgctgtgcattgtctggttcacttttgagctcctggtgcgcttctccgcctgccctagcaagccggccttcttccggaacatcatgaacatcattgacttggtggctatcttcccctacttcatcaccctgggcactgagctggtgcagcagcaggagcagcaaccagccagtggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacgatgacgattcgctttttcccagcatcccggatgccttctggtgggcagtggttacaatgaccacggtaggttacggggacatgtaccccatgactgtggggggaaagatcgtgggctcgctgtgtgccatcgctggggtcctcaccattgccctgcctgtgcccgtcatcgtctccaacttcaactacttctaccaccgggagacggagcaggaggagcaaggccagtatacccacgtcacttgtgggcagcctgcgccggacctgagggcaactgacaacggacttggcaagcctgacttccccgaggctaaccgggaacggagacccagctaccttcctacaccacatcgggcctatgcagagaaaagaatgctcacggaggtctgacccatgcaggcagggcctgcaggaggggagcactgagctaacagtctcttaggcttccttctcatttccactactcactctagcttcagttgacttcttgactctctcccctacacccactacctggcatccaggaccaaatacctggactatcaaccttgttgcttaatccctgcagcattcaaggttaatccatctaagtgacatttttgaaattccagcggtgccacccaatcatgcccagcttctgtcatatgaatgagatatacatttatatgacagaagctgggcatgattgggtggcaccgctggaatttcaaaaatgtcaaggaacagcaaatgtcaacaggatggaaaccagccctatctgagtcttcgctccctccttagtgttctttgctttgggtcatgtgcgtttcctagcttcaggccacttggtaactggaagaagctggaggacagaagcagtactcaacttgctgttattccagtgccctgtaacaaccactggtcctcctgcagatgacccttggtagagtctttatttgcatagcctcaaaataggttattcgttctaaacttggatggaattagagaatacaatcaaactttaccacttggaggacacggggttagtccaggaccaaagaggccaatggatttttcaaagtgtgccccagcacacagaggcactggtgttcggtctacatttagttctccccactctgatcccctgactctccagcttccaggaaggttccttctcagagccaaatactctttgtgcaagtgccttcctgagcagaagaactggagaaagggaaccacagagccaggaggaatgtctgagcagagtcaagcaactggcttgaccacagtctgaagcaaggtgccacttaaacagatactgttttctcaaaggggcagaggaatcgtgttgcagatggcagccttttctccttcattttccccacattttctctggccctctaccttgcttcctgggagtttgatttaggattgctgttgaaggcttcctcaggcaaactccagcttaaagccctagacaggtaaaagcacacattggatggcagcatgggtttcttcccattttatgggcatgaaatatgtggtttagaataaggaacaagcattattcctttgccaacagcctcactctaagaggcttttttgctgagtcaagcaaacacttgcctgctctgccccttggaggtgcatttgacctgctctcactggtaaggtgacttggtggcgttcccacttgatttagccattttcttccattgtgagaccactgccatctatccacctgcccacctccccttttgtttctcagtaacattgccatttgttttttgcctttgataaactgtgatgtactgttctgagatcttttgggtgcagttctgaaactgaaaggactgttaacatgtttttaattttatatctatgctttcagactctttgatgataatttttttttttaaaaattatctctcgaagagcaacttacgagaggacagccttatgagggtttgcttgagaggcagtgtggcttctgtgactgccagctctaaatctcgatcttgccataactttacagggtaacttgggtccacagtcactctttgtgcctcagtttacccacccattaaatgggaacattactgtcttcccctccctacctcatggggaatgtctgggaagctggggacattgctatgcaaatgtgtgaatcttagtcatggatttgatttttag

SEQ ID NO: 14 - protein, 529 aa, Homo sapiens
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 15 - DNA, 7648 bp, Homo sapiens
  CDS (1)...(7134)
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgcaggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggccca

SEQ ID NO: 16 - protein, 2377 aa, Homo sapiens
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 17 - DNA, 4092 bp, Homo sapiens
  CDS (200)...(3031)
agccagcccttgccgtggccggagccgagcggcgcatccgggccggagaagaggacgacgacgaggtcctcgaagtggacccgtttgcgaagcgccagggagaaggaggagcggacgcatcgtagaaaggggtggtggcgcccgaccccgcgccccggcccgaagctctgagggcttcccggcccccactgcctgcggcatggcccggggctcggcgctcccgcggcggccgctgctgtgcatcccggccgtctgggcggccgccgcgcttctgctctcagtgtcccggacttcaggtgaagtggaggttctggatccgaacgaccctttaggaccccttgatgggcaggacggcccgattccaactctgaaaggttactttctgaattttctggagccagtaaacaatatcaccattgtccaaggccagacggcaattctgcactgcaaggtggcaggaaacccaccccctaacgtgcggtggctaaagaatgatgccccggtggtgcaggagccgcggcggatcatcatccggaagacagaatatggttcacgactgcgaatccaggacctggacacgacagacactggctactaccagtgcgtggccaccaacgggatgaagaccattaccgccactggcgtcctgtttgtgcggctgggtccaacgcacagcccaaatcataactttcaggatgattaccacgaggatgggttctgccagccttaccggggaattgcctgtgcacgcttcattggcaaccggaccatttatgtggactcgcttcagatgcagggggagattgaaaaccgaatcacagcggccttcaccatgatcggcacgtctacgcacctgtcggaccagtgctcacagttcgccatcccatccttctgccacttcgtgtttcctctgtgcgacgcgcgctcccgggcacccaagccgcgtgagctgtgccgcgacgagtgcgaggtgctggagagcgacctgtgccgccaggagtacaccatcgcccgctccaacccgctcatcctcatgcggcttcagctgcccaagtgtgaggcgctgcccatgcctgagagccccgacgctgccaactgcatgcgcattggcatcccagccgagaggctgggccgctaccatcagtgctataacggctcaggcatggattacagaggaacggcaagcaccaccaagtcaggccaccagtgccagccgtgggccctgcagcacccccacagccaccacctgtccagcacagacttccctgagcttggaggggggcacgcctactgccggaaccccggaggccagatggagggcccctggtgctttacgcagaataaaaacgtacgcatggaactgtgtgacgtaccctcgtgtagtccccgagacagcagcaagatggggattctgtacatcttggtccccagcatcgcaattccactggtcatcgcttgccttttcttcttggtttgcatgtgccggaataagcagaaggcatctgcgtccacaccgcagcggcgacagctgatggcctcgcccagccaagacatggaaatgcccctcattaaccagcacaaacaggccaaactcaaagagatcagcctgtctgcggtgaggttcatggaggagctgggagaggaccggtttgggaaagtctacaaaggtcacctgttcggccctgccccgggggagcagacccaggctgtggccatcaaaacgctgaaggacaaagcggaggggcccctgcgggaggagttccggcatgaggctatgctgcgagcacggctgcaacaccccaacgtcgtctgcctgctgggcgtggtgaccaaggaccagcccctgagcatgatcttcagctactgttcgcacggcgacctccacgaattcctggtcatgcgctcgccgcactcggacgtgggcagcaccgatgatgaccgcacggtgaagtccgccctggagccccccgacttcgtgcaccttgtggcacagatcgcggcggggatggagtacctatccagccaccacgtggttcacaaggacctggccacccgcaatgtgctagtgtacgacaagctgaacgtgaagatctcagacttgggcctcttccgagaggtgtatgccgccgattactacaagctgctggggaactcgctgctgcctatccgctggatggccccagaggccatcatgtacggcaagttctccatcgactcagacatctggtcctacggtgtggtcctgtgggaggtcttcagctacggcctgcagccctactgcgggtactccaaccaggatgtggtggagatgatccggaaccggcaggtgctgccttgccccgatgactgtcccgcctgggtgtatgccctcatgatcgagtgctggaacgagttccccagccggcggccccgcttcaaggacatccacagccggctccgagcctggggcaacctttccaactacaacagctcggcgcagacctcgggggccagcaacaccacgcagaccagctccctgagcaccagcccagtgagcaatgtgagcaacgcccgctacgtggggcccaagcagaaggccccgcccttcccacagccccagttcatccccatgaagggccagatcagacccatggtgcccccgccgcagctctacgtccccgtcaacggctaccagccggtgccggcctatggggcctacctgcccaacttctacccggtgcagatcccaatgcagatggccccgcagcaggtgcctcctcagatggtccccaagcccagctcacaccacagtggcagtggctccaccagcacaggctacgtcaccacggccccctccaacacatccatggcagacagggcagccctgctctcagagggcgctgatgacacacagaacgccccagaagatggggcccagagcaccgtgcaggaagcagaggaggaggaggaaggctctgtcccagagactgagctgctgggggactgtgacactctgcaggtggacgaggcccaagtccagctggaagcttgagtggcaccagggcccggggttcggggatagaagccccgccgagaccccacagggacctcagtcacctttgagaagacaccatactcagcaatcacaagagcccgccggccagtgggcttgtttgcagactgggtgaggtggagccctgctcctctctgtcctctgacacagagagctgccctgcctaggagcacccaagccaggcagggggtctggcagcacggcgtcctggggagcaggacacatggtcatccccagggctgtatacattgattctggtggtagactggtagtgagcagcaaatgcctttcaagaaaataggtggcagcttcactccatgtcatatatggagtgaatatttcaaaacgttgggaataagggcctgcaaaaggcagcgaggaggcacctcgggtcttgaggttcctgacaaccgatctggtctgttggtttgaggatgaaggggctccatttctgctgcctccctgctgagaatattctccctttagcagccaaagattcgctggaacggaggctgccctctgctgcctgttggggtcggaagacaaggggcttctgaaatgggagttcctgagatacaacaaaatgtgtgccttcaaagaaactgacagctttgtatttggtgaaatggttttaattatactccatgtgtattttgcccactttttttgggaattcaagggaaagtgtttcttgggtttggaatgttcagaggaagcagtattgtacagaacacggtattgttatttttgttaagaatcatgtacagagcttaaatgtaatttatatgtttttaatatgccattttcattgaagtattttggtcttaagatgactttagtaatttaactgtttatgttacccacgttgggatccagttggtcttggtttgcttctctctgtaccacgtgcacatgaggtccattcattttacagcccctgttacacacagacccacaggcagccgtctgtgcccgcacacattgttggtcctatttgtaaatcccacacccggtgtatccaataaagtgaaaccaacccc

SEQ ID NO: 18 - protein, 943 aa, Homo sapiens [sequence omitted]

SEQ ID NO: 19 - DNA, 2685 bp, Homo sapiens
  CDS (31)...(2220)
cgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacacgactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcacgtgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattcggtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctaaccccaattccctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcccg

SEQ ID NO: 20 - protein, 729 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKTIIYLSLVYVLGHVIKSLGALPILGGQVVHTVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRHDWLDWAAEKYPKQLIMDVKALTRVLFLYIPLPMFWALLDQQGSRWTLQAIRMNRNLGFFVLQPDQMQVLNPLLVLIFIPLFDFVIYRLVSKCGINFSSLRKMAVGMILACLAFAVAARVEIKINEMAPAQPGPQEVFLQVLNLADDEVKVTVVGNENNSLLIESIKSFQKTPHYSKLHLKTKSQDFHFHLKYHNLSLYTEHSVQEKNWYSLVIREDGNSISSMMVKDTESRTTNGMTTVRFVNTLHKDVNISLSTDTSLNVGEDYGVSAYRTVQRGEYPAVHCRTEDKNFSLNLGLLDFGAAYLFVITNNTNQGLQAWKIEDIPANKMSIRWQLPQYALVTAGEVMFSVTGLEFSYSQAPSSMKSVLQAAWLLTIAVGNIIVLVVAQFSGLVQWAEFILFSCLLLVICLIFSIMGYYYVPVKTEDMRGPADKHIPHIQGNMIKLETKKTKL

SEQ ID NO: 21 - DNA, 831 bp, Homo sapiens
  CDS (1)...(831)
atgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactga

SEQ ID NO: 22 - protein, 276 aa, Homo sapiens
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVPGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 23 - DNA, 2043 bp, Homo sapiens
  CDS (192)...(1346)
  misc_feature (1)...(2043): n = A,T,C or G
tntcacmyyyktccycctyctcgagctccctttmtccccctcccccagcccattattctgcttcagtcttttgtgtcagcggcagarggctgaggggatggatttgccyttcygscaggcaggacagtgtcaggatggaccgcgctgccagaagccgacgctagcgagggaggtgtgaagagttggccagaatgaccaactcctcctccacatccacctcctccaccaccggtggctcgctgctgctgctctgcgaggaagaggagtcgtgggcgggccggcgcatcccggtgtcactcctgtattcgggcctggccatcgggggcacgctggccaacggcatggtcatctatctcgtgtcgtccttccgaaagctgcagaccaccagcaacgccttcatcgtgaacggctgcgccgccgacctcagcgtctgcgccctctggatgccgcaggaggcggtgctcgggctcctgcccaccggctctgcggagccccccgcagactgggacggcgctgggggcagctaccgcctgctacggggtgggctgctgggcctcggactcacggtgtccctcctctcccactgcctcgtggccctgaaccgctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatggggccttcgaccccagcgggctacctgaaccaaggcgtctctctaagtggggcgcccgaagtcattttggacggccacctgatttttaccctttgtttctgtgttttagaggaatcctaaagacagaacaccagagacttgaagaacttgcaaactggcgttttaaaataaccggttaatttatttccacacagtttgtttttgaaaaagagctttcataatgtataaccctttccactttcatcgtcttatatatgaagcgccttgagtgtgcatgaaccaaaggaaataacattgaagaaggaaaacaatatgtagaaagtattyttagaaagtaacctgtctttgatgatgcttctcttaccatttagntntttgtatattaccctggggcagttgaagccctaggtgtgcccaccagtatgagttgccattaagacctcaagccctttattcttaaaagggtttytaataaaagtctttctcaaatgaggtagaatcttagccaagtngagaaaaaaaaattattttatgctccttttttttcgcacctcttaaagac

SEQ ID NO: 24 - protein, 384 aa, Homo sapiens
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRVHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVQAASWLLCCALSALNPLLYTWRNEEFRRSVRSVLPGVGDAAAAAVAATAVPAVSQAQLGTRAAGQHW

SEQ ID NO: 25 - DNA, 2809 bp, Homo sapiens
  CDS (361)...(2655)
ggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggagtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagcccggatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactcaaaaaaaaaaaaaaaaaaaaaaaaaaaaaaaaaaaaaaaaa

SEQ ID NO: 26 - protein, 764 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMISDNSAENIALVTSMYDGLLQAGARLCPTVQLEDIRNLQDLTPLKLAAKEGKIEIFRHILQREFSGLSHLSRKFTEWCYGPVRVSLYDLASVDSCEENSVLEIIAFHCKSPHRHRMVVLEPLNKLLQAKWDLLIPKFFLNFLCNLIYMFIFTAVAYHQPTLKKQAAPHLKAEVGNSMLLTGHILILLGGIYLLVGQLWYFWRRHVFIWISFIDSYFEILFLFQALLTVVSQVLCFLAIEWYLPLLVSALVLGWLNLLYYTRGFQHTGIYSVMIQKVILRDLLRFLLIYLVFLFGFAVALVSLSQEAWRPEAPTGPNATESVQPMEGQEDEGNGAQYRGILEASLELFKFTIGMGELAFQEQLHFRGMVLLLLLAYVLLTYILLLNMLIALMSETVNSVATDSWSIWKLQKAISVLEMENGYWWCRKKQRAGVMLTVGTKPDGSPDERWCFRVEEVNWASWEQTLPTLCEDPSGAGVPRTLENPVLASPPKEDEDGASEENYVPVQLLQSN

SEQ ID NO: 27 - DNA, 1506 bp, Homo sapiens
  CDS (246)...(980)
aggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccatcaggcagtggctgttggaaagatttaagatttcacacctatgacatacatgggatagcacctgggccgccatgcactcaataaagaatgtatttt

SEQ ID NO: 28 - protein, 244 aa, Homo sapiens
MKKLMVVLSLIAAAWAEEQNKLVHGGPCDKTSHPYQAALYTSGHLLCGGVLIHPLWVLTAAHCKKPNLQVFLGKHNLRQRESSQEQSSVVRAVIHPDYDAASHDQDIMLLRLARPAKLSELIQPLPLERDCSANTTSCHILGWGKTADGDFPDTIQCAYIHLVSREECEHAYPGQITQNMLCAGDEKYGKDSCQGDSGGPLVCGDHLRGLVSWGNIPCGSKEKPGVYTNVCRYTNWIQKTIQAK

SEQ ID NO: 29 - DNA, 4113 bp, Homo sapiens
  CDS (101)...(3691)
caaagagcggctcgcgcgctggcctgggctctaaccgaggagagatcccgggagaactccagagctccgggggagcgctcctcggaagaccggggccaacatgcctgtgcgcagggggcatgtggcaccacaaaatacatttctggggaccatcattcggaaatttgaagggcaaaataaaaaatttatcattgcaaatgccagagtgcagaactgtgccatcatttattgcaacgatgggttctgtgagatgactggtttctccaggccagatgtcatgcaaaagccatgcacctgcgactttctccatggacccgagaccaagaggcatgatattgcccaaattgcccaggcattgctggggtcagaagagaggaaagtggaggtcacctactatcacaaaaatgggtccacttttatttgtaacactcacataattccagtgaaaaaccaagagggcgtggctatgatgttcatcattaattttgaatatgtgacggataatgaaaacgctgccaccccagagagggtaaacccaatattaccaatcaaaactgtaaaccggaaattttttgggttcaaattccctggtctgagagttctcacttacagaaagcagtccttaccacaagaagaccccgatgtggtggtcatcgattcatctaaacacagtgatgattcagtagccatgaagcattttaagtctcctacaaaagaaagctgcagcccctctgaagcagatgacacaaaagctttgatacagcccagcaaatgttctcccttggtgaatatatccggacctcttgaccattcctctcccaaaaggcaatgggaccgactctaccctgacatgctgcagtcaagttcccagctgtcccattccagatcaagggaaagcttatgtagtatacggagagcatcttcggtccatgatatagaaggattcggcgtccaccccaagaacatatttagagaccgacatgccagcgaagacaatggtcgcaatgtcaaagggccttttaatcatatcaagtcaagcctcctgggatccacatcagattcaaacctcaacaaatacagcaccattaacaagattccacagctcactctgaatttttcagaggtcaaaactgagaaaaagaattcatcacctccttcttcagataaaaccattattgcacccaaggttaaagatcgaacacacaatgtgactgagaaagtgacccaggttctctctttaggagcagatgtcctacctgaatacaaactgcagacaccacgcatcaacaagtttacgatattgcactacagccctttcaaggcagtctgggactggcttatcctgctgttggtcatatacactgctatatttactccctactctgcagccttcctcctcaatgacagagaagaacagaagagacgagaatgtggctattcttgtagccctttgaatgtggtagacttgattgtggatattatgtttatcatagatattttaataaacttcagaacaacatatgttaatcagaatgaagaagtggtaagtgatcccgccaaaatagcaatacactacttcaaaggctggttcctgattgacatggttgcagcaattccttttgacttgctgatttttggatcaggttctgatgagacaacaacattaattggtcttttgaagactgcccgactcctccgtcttgtgcgcgtggccaggaaactggatcgatattcagaatatggcgctgctgttctaatgctctcaatgtgcatctttgccctgaatgcacactggctggcttgcatttggtatgcgattgggaatgtagaaaggccttacctgactgacaaaatcggatggttggattccttaggacagcaaattgggaaacgttacaatgacagtgactcaagttctggaccatccattaaagacaaatacgtcacagcactttattttaccttcagcagtttaaccagtgtaggattcgggaatgtgtctcctaacacgaattcggagaaaatcttttcaatttgtgtcatgttgattggctcactaatgtatgcaagcatttttgggaatgtatctgcaattatccaaagactatactcgggaactgccaggtaccacatgcagatgctgcgagtaaaagagttcattcgctttcaccaaatccccaaccctctgaggcaacgtcttgaagaatatttccagcacgcatggacttacaccaatggcattgacatgaacatggtcctaaagggtttcccagaatgcttacaagcagacatttgtctacatctcaaccagacattgctgcaaaactgcaaagcctttcggggggcaagtaaaggttgccttagagctttggcaatgaagttcaaaaccacccatgcactccaaggagacaccctcgttcactgtggggatgtcctcactgcactttatttcttatccagaggctccattgaaatctcaaagaatgacatggtggtggctattctgggaaaaaatgatatatttggagaaatggttcatctttatgccaaacctggaaagtctaatgcagatgtaagagccctcacatactgtgacttgcataagattcagcgagaagacttgttagaggttttggatatgtatcctgagttttctgatcactttctaacaaacctagagttgactttcaacctaaggcatgagagcgcaaaggctgatctcctacgatcacaatccatgaatgattcagaaggagacaactgtaaactaagaagaaggaaattgtcatttgaaagtgaaggagagaaagaaaacagtacaaatgatcctgaagactctgcagataccataagacattatcagagttccaagagacactttgaagagaaaaaaagcagatcctcatctttcatctcctccattgatgatgaacaaaagccgctcttctcaggaatagtagactcttctccaggaatagggaaagcatctgggctcgattttgaagaaacagtgcccacctcaggaagaatgcacatagataaaagaagtcactcttgcaaagatatcactgacatgcgaagctgggaacgagaaaatgcacatccccagcctgaagactccagtccatctgcacttcagcgagctgcctggggtatctctgaaaccgaaagcgacctcacctacggggaagtggaacaaagattagatctgctccaggagcaacttaacaggcttgaatcccaaatgaccactgacatccagaccatcttacagttgctgcagaaacaaaccactgtggtccccccagcctacagtatggtaacagcaggatcagaatatcagagacccatcatccagctgatgagaaccagtcaaccggaagcatccatcaaaactgaccgaagtttcagcccttcctcacaatgtcctgaatttctagaccttgaaaaatctaaacttaaatccaaagaatccctttcaagtggggtgcatctgaacacagcttcagaagacaacttgacttcacttttaaaacaagacagtgatctctctttagagcttcacctgcggcaaagaaaaacttacgttcatccaattaggcatccttctttgccagattcatccctaagcactgtaggaatcgtgggtcttcataggcatgtttctgatcctggtcttccagggaaataatcattttgtactatttactccacatacaatgtaagtgcttttaatggctgttttcctttttctatttaaatcctctctacttgactcaggggctcacaaggtaccattatatgcaaaagtactgtatattttcctaaattgaagcttgtaaggtaaaactgagcagttaggatgtaaatatacataagaacttttggttccaaatgttaaaactgccagcatctcacggcaccttattttttatttttattttttaaatcacatgcatgttaggaaactccaatttctcttgcatggagactcctatttactgcttttactaaaccagtacttcgttatgaaaatgccttccacgcaaataagaaaccaagggataaaactgttcatggatgcaactcaaattcagatgatcatcaaggcat

SEQ ID NO: 30 - protein, 1196 aa, Homo sapiens [sequence omitted]

SEQ ID NO: 31 - DNA, 1609 bp, Homo sapiens
  CDS (176)...(1372)
gtcgaccacgcgtccggagcccagcacagctgccctctggaccctgcggaccccagcccgagccccttcctgagttccacaggcgcagcccccgggcggtcgggcggaggggtccccggggcggtgccagggcgcaatcctggagggcggccgggaggaggaggtgcgcgcggccatgcacaccgtggctacgtccgggcccaacgcgtcctggggggcaccggccaacgcctccggctgcccgggctgtggcgccaacgcctcggacggcccagtcccttcgccgcgggccgtggacgcctggctcgtgccgctcttcttcgcggcgctgatgctgctgggcctggtggggaactcgctggtcatctacgtcatctgccgccacaagccgatgcggaccgtgaccaacttctacatcgccaacctggcggccacggacgtgaccttcctcctgtgctgcgtccccttcacggccctgctgtacccgctgcccggctgggtgctgggcgacttcatgtgcaagttcgtcaactacatccagcaggtctcggtgcaggccacgtgtgccactctgaccgccatgagtgtggaccgctggtacgtgacggtgttcccgttgcgcgccctgcaccgccgcacgccccgcctggcgctggctgtcagcctcagcatctgggtaggctctgcggcggtgtctgcgccggtgctcgccctgcaccgcctgtcacccgggccgcgcgcctactgcagtgaggccttccccagccgcgccctggagcgcgccttcgcactgtacaacctgctggcgctgtacctgctgccgctgctcgccacctgcgcctgctatgcggccatgctgcgccacctgggccgggtcgccgtgcgccccgcgcccgccgatagcgccctgcaggggcaggtgctggcagagcgcgcaggcgccgtgcgggccaaggtctcgcggctggtggcggccgtggtcctgctcttcgccgcctgctggggccccatccagctgttcctggtgctgcaggcgctgggccccgcgggctcctggcacccacgcagctacgccgcctacgcgcttaagacctgggctcactgcatgtcctacagcaactccgcgctgaacccgctgctctacgccttcctgggctcgcacttccgacaggccttccgccgcgtctgcccctgcgcgccgcgccgcccccgccgcccccgccggcccggaccctcggaccccgcagccccacacgcggagctgcaccgcctggggtcccacccggcccccgccagggcgcagaagccagggagcagtgggctggccgcgcgcgggctgtgcgtcctgggggaggacaacgcccctctctgagcggacccggtgggaatccgagcggctccctcgggagcggggactgctggaacagcggctattcttctgttattagtatttttcttactgtccaagatcaactgtggaaatattttggtctcttgtgacgttcggtgcagtttcgttgtgaagtttgctattgatattgaaattatgacttctgtgtttcctgaaattaaacatgtgtcaacaaaaaaaaaaaaaaaaaaagggcgg

SEQ ID NO: 32 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELHRLGSHPAPARAQKPGSSGLAARGLCVLGEDNAPL

SEQ ID NO: 33 - DNA, 3344 bp, Homo sapiens
  CDS (41)...(2668)
aagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacagttgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtgc

SEQ ID NO: 34 - protein, 875 aa, Homo sapiens
MTLARFVLALMLGALPEVVGFDSVLNDSLHHSHRHSPPAGPHYPYYLPTQQRPPTTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 35 - DNA, 1635 bp, Homo sapiens
  CDS (1)...(1635)
atgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaa

SEQ ID NO: 36 - protein, 544 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 37 - DNA, 4635 bp, Homo sapiens
  CDS (435)...(4058)
tcgcgatctagaactagtggcacggctcctgcactcccactgccgcaggaactgctcaggaacctgccggtctccggctgggacggtggctggatcagctcaagcctccagggccctgaggctgaggggctgagtgctcattccagccgcctcggggaacccgggctgggagaccccatgcctgggggtgagcctggagccagggcagtgcggtgagaggctccggagagagggctgggcaccaccaggcttgggtgtgtgatgcgctgctggcccaggctacaccccgacaagggacaccgggggccctgggagcagagagacctcagagcagcctcctcctgcctcctgtggacggccggccccagctggtgatcccagccagtcccagctttcagttgctgcccccaccgacagtcctcagtccctccatgatggctcccccgacagccggcccccttcctggcccagctcttccgcctgaggacccagggccggatccggagagcaggtggcttttcttgagcgccaacattctgcccgtggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccatgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgcttgcctccgtagttaggaactgagagcggcgagtgacaggtaacggggcccagccccg

SEQ ID NO: 38 - protein, 1207 aa, Homo sapiens
MAPPTAGPLPGPALPPEDPGPDPESRWLFLSANILPVVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAGKPLLPCVVLPHAPGMAGPGSPAAASAWTVSPRVLVLVALYPWHCLRGTLLPWLACGP

SEQ ID NO: 39 - DNA, 1041 bp, Homo sapiens
  CDS (1)...(1041)
atggagagaaaatttatgtccttgcaaccatccatctccgtatcagaaatggaaccaaatggcaccttcagcaataacaacagcaggaactgcacaattgaaaacttcaagagagaatttttcccaattgtatatctgataatatttttctggggagtcttgggaaatgggttgtccatatatgttttcctgcagccttataagaagtccacatctgtgaacgttttcatgctaaatctggccatttcagatctcctgttcataagcacgcttcccttcagggctgactattatcttagaggctccaattggatatttggagacctggcctgcaggattatgtcttattccttgtatgtcaacatgtacagcagtatttatttcctgaccgtgctgagtgttgtgcgtttcctggcaatggttcacccctttcggcttctgcatgtcaccagcatcaggagtgcctggatcctctgtgggatcatatggatccttatcatggcttcctcaataatgctcctggacagtggctctgagcagaacggcagtgtcacatcatgcttagagctgaatctctataaaattgctaagctgcagaccatgaactatattgccttggtggtgggctgcctgctgccatttttcacactcagcatctgttatctgctgatcattcgggttctgttaaaagtggaggtcccagaatcggggctgcgggtttctcacaggaaggcactgaccaccatcatcatcaccttgatcatcttcttcttgtgtttcctgccctatcacacactgaggaccgtccacttgacgacatggaaagtgggtttatgcaaagacagactgcataaagctttggttatcacactggccttggcagcagccaatgcctgcttcaatcctctgctctattactttgctggggagaattttaaggacagactaaagtctgcactcagaaaaggccatccacagaaggcaaagacaaagtgtgttttccctgttagtgtgtggttgagaaaggaaacaagagtataa

SEQ ID NO: 40 - protein, 346 aa, Homo sapiens
MERKFMSLQPSISVSEMEPNGTFSNNNSRNCTIENFKREFFPIVYLIIFFWGVLGNGLSIYVFLQPYKKSTSVNVFMLNLAISDLLFISTLPFRADYYLRGSNWIFGDLACRIMSYSLYVNMYSSIYFLTVLSVVRFLAMVHPFRLLHVTSIRSAWILCGIIWILIMASSIMLLDSGSEQNGSVTSCLELNLYKIAKLQTMNYIALVVGCLLPFFTLSICYLLIIRVLLKVEVPESGLRVSHRKALTTIIITLIIFFLCFLPYHTLRTVHLTTWKVGLCKDRLHKALVITLALAAANACFNPLLYYFAGENFKDRLKSALRKGHPQKAKTKCVFPVSVWLRKETRV

SEQ ID NO: 41 - DNA, 2000 bp, Homo sapiens
  CDS (84)...(1250)
cggcgggctgctcggacttggcgcggggccggcccggcctctctcttcctcggtggggcctagacggtcggggcaccgggaacatggagccctctccagccgctgggggcttggagaccactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaacagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtcataccccttccctctctcccctccctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaagttgtgtctcactgcaaaaaaaaaaa

SEQ ID NO: 42 - protein, 388 aa, Homo sapiens
MEPSPAAGGLETTRLVSPRDRGGAGGSLRLKSLFTEPSEPLPEESKPVEMPFHHCHRDPLPPPGLTPERLHARRQLYAACAVCFVFMAGEVVGGYLAHSLAIMTDAAHLLADVGSMMGSLFSLWLSTRPATRTMTFGWHRSETLGALASVVSLWMVTGILLYLAFVRLLHSDYHIEGGAMLLTASIAVCANLLMAFVLHQAGPPHSHGSRGAEYAPLEEGPEQPLPLGNTSVRAAFVHVLGDLLQSFGVLAASILIYFKPQYKAADPISTFLFSICALGSTAPTLRDVLRILMEGTPRNVGFEPVRDTLLSVPGVRATHELHLWALTLTYHVASAHLAIDSTADPEAVLAEASSRLYSRFGFSSCTLQVEQYQPEMAQCLRCQEPPQA

SEQ ID NO: 43 - DNA, 1506 bp, Homo sapiens
  CDS (157)...(1362)
ctagggagggcgccatctgagtagttcggaagaactgaacatgatgagttgccggctgcttcctgagtccttggggaagcacacgcaccatccacttagcactggagcctggctgttctccgggcactcctaccccatcttcctggcggggcttagatgctcctgcctcttccaccagctcctcttgccctgcatgcttcagggacgatggaggtctcggggcacccccaggccaggagatgctgcccagaggccctgggaaagctcttccctggcctctgcttcctctgctttctggtgacctacgccctggtgggtgctgtggtcttctctgccattgaggacggccaggtcctggtggcagcagatgatggagagtttgagaagttcttggaggagctctgcagaatcttgaactgcagtgaaacagtggtggaagacagaaaacaggatctccaggggcatctgcagaaggtgaagcctcagtggtttaacaggaccacacactggtccttcctgagctcgctctttttctgctgcacggtgttcagcaccgtgggctatggctacatctaccccgtcaccaggcttggcaagtacttgtgcatgctctatgctctctttggtatccccctgatgttcctcgttctcacggacacaggcgacatcctggcaaccatcttatctacatcttataatcggttccgaaaattccctttctttacccgccccctcctctccaagtggtgccccaaatctctcttcaagaaaaaaccggaccccaagcccgcagatgaagctgtccctcagatcatcatcagtgctgaagagcttccaggccccaaacttggcacatgtccttcacgcccaagctgcagcatggagctgtttgagagatctcatgcgctagagaaacagaacacactgcaactgcccccacaagccatggagaggagtaactcgtgtcccgaactggtgttgggaagactctcatactccatcatcagcaacctggatgaagttggacagcaggtggagaggttggacatccccctccccatcattgcccttattgtttttgcctacatttcctgtgcagctgccatcctccccttctgggagacacagttggatttcgagaatgccttctatttctgctttgtcacactcaccaccattgggtttggggatactgttttagaacaccctaacttcttcctgttcttctccatttatatcatcgttggaatggagattgtgttcattgctttcaagttggtgcaaaacaggctgattgacatatacaaaaatgttatgctattctttgcaaaagggaagttttaccaccttgttaaaaagtgaaggtttcattatctctcaggtgacagacactggctgagctggttttcttgtgttgtctttcagggtcatgcagcctgtcacctgagaccttcagtcttggagacaaatcccttatgagagccaagttcagtcttgaggccctgc

SEQ ID NO: 44 - protein, 401 aa, Homo sapiens
MLLPLPPAPLALHASGTMEVSGHPQARRCCPEALGKLFPGLCFLCFLVTYALVGAVVFSAIEDGQVLVAADDGEFEKFLEELCRILNCSETVVEDRKQDLQGHLQKVKPQWFNRTTHWSFLSSLFFCCTVFSTVGYGYIYPVTRLGKYLCMLYALFGIPLMFLVLTDTGDILATILSTSYNRFRKFPFFTRPLLSKWCPKSLFKKKPDPKPADEAVPQIIISAEELPGPKLGTCPSRPSCSMELFERSHALEKQNTLQLPPQAMERSNSCPELVLGRLSYSIISNLDEVGQQVERLDIPLPIIALIVFAYISCAAAILPFWETQLDFENAFYFCFVTLTTIGFGDTVLEHPNFFLFFSIYIIVGMEIVFIAFKLVQNRLIDIYKNVMLFFAKGKFYHLVKK

SEQ ID NO: 45 - DNA, 2158 bp, Homo sapiens
  CDS (96)...(1841)
ccacgcgtccgaaaaacaggcctggagagcaatgtggagtaagcaatgtaataaaaacgatttaaaaattattcttaataaaagtacgaatcccaatgccacagggacttacttcatctgcttcacaatggtgctttttcctgattctccagcccctgttgggacacagacagtggggaaaaactgggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccatcatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagatgctggtgcacctgtctacttctatgagtttcggcaccggcctcagtgctttgaagacacgaagccggcttttgtcaaagccgaccacgctgatgaagtccgctttgtgttcggtggtgccttcctgaagggggacattgttatgttcgaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcctattagttgtcataataatggttttgtaactcatatgaaataaaatcagaatgtaaaataggaaaaaaaaaaaaaaaaaaaa

SEQ ID NO: 46 - protein, 581 aa, Homo sapiens
MPQGLTSSASQWCFFLILQPLLGHRQWGKTGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHRDAGAPVYFYEFRHRPQCFEDTKPAFVKADHADEVRFVFGGAFLKGDIVMFEGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 47 - DNA, 1107 bp, Homo sapiens
  CDS (56)...(688)
cgccgggggcgggagggggcggggggagcacgccagccgccgagagtggggggcgatggcgaagctccgggtggcttacgagtacacggaagccgaggacaagagcatccggctcggcttgtttctcatcatctccggcgtcgtgtcgctcttcatcttcggcttctgctggctgagtcccgcgctgcaggatctgcaagccacggaggccaattgcacggtgctgtcggtgcagcagatcggcgaggtgttcgagtgcaccttcacctgtggcgccgactgcaggggcacctcgcagtacccctgcgtccaggtctacgtgaacaactctgagtccaactctagggcgctgctgcacagcgacgagcaccagctcctgaccaaccccaagtgctcctatatccctccctgtaagagagaaaatcagaagaatttggaaagtgtcatgaattggcaacagtactggaaagatgagattggttcccagccatttacttgctattttaatcaacatcaaagaccagatgatgtgcttctgcatcgcactcatgatgagattgtcctcctgcattgcttcctctggcccctggtgacatttgtggtgggcgttctcattgtggtcctgaccatctgtgccaagagcttggcggtcaaggcggaagccatgaagaagcgcaagttctcttaaaggggaaggaggcttgtagaaagcaaagtacagaagctgtactcatcggcacgcgtccacctgcggaacctgtgtttcctggcgcaggagatggacagggccacgacagggctctgagaggctcatccctcagtggcaacagaaacaggcacaactggaagacttggaacctcaaagcttgtattccatctgctgtagcaatggctaaagggtcaagatcttagctgtatggagtaactatttcagaaaaccctataagaagttcattttctttcaaaagtaacagtatattatttgtacagtgtagtatacaaaccattatgatttatgctacttaaaaatattaaaatagagtggtctgtgttattttctatttccttttttatgcttagaacaccagggttaaaaaaaaaaaaaaa

SEQ ID NO: 48 - protein, 210 aa, Homo sapiens
MAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 49 - DNA, 1242 bp, Homo sapiens
  CDS (1)...(1143)
aagaggctctctctgcccatggatatccgcctgccccaggaattcctacagaagctacagatggagagcccagatctgcccaagccgctcagccgcatgtcccgccgggcctccctgtcagacattggctttgggaaactggaaacatacgtgaaactggacaaactgggagagggcacctatgccacagtcttcaaagggcgcagcaaactgacggagaaccttgtggccctgaaagagatccggctggagcacgaggagggagcgccctgcactgccatccgagaggtgtctctgctgaagaacctgaagcacgccaatattgtgaccctgcatgacctcatccacacagatcggtccctcaccctggtgtttgagtacctggacagtgacctgaagcagtatctggaccactgtgggaacctcatgagcatgcacaacgtcaagattttcatgttccagctgctccggggcctcgcctactgtcacacccgcaagatcctgcaccgggacctgaagccccagaacctgctcatcaacgagaggggggagctgaagctggccgactttggactggccagggccaagtcagtgcccacaaagacttactccaatgaggtggtgaccctgtggtacaggccccccgatgtgctgctgggatccacagagtactccacccccattgctatgtggggcgtgggctgcatccactacgagatggccacagggaggcccctcttcccgggctccacagtcaaggaggagctgcacctcatctttcgcctcctcgggacccccacagaagagacgtggcccggcgtgaccgccttctctgagttccgcacctacagcttcccctgctacctcccgcagccgctcatcaaccacgcgcccaggttggatacggatggcatccacctcctgagcagcctgctcgtgtatgaatccaagagtcgcatgtcagcagaggctgccctgagtcactcctacttccggtctctgggagagcgtgtgcaccagcttgaagacactgcctccatcttctccctgaaggagatccagctccagaaggacccaggctaccgaggcttggccttccagcagccaggacgagggaagaacaggcggcagagcatcttctgagccacgcccaccttgctgtggccaagggacaagagaccacatggagcacaaattcgggtaggatggagcctgtgtggccctcggaggactgaacaacga

SEQ ID NO: 50 - protein, 380 aa, Homo sapiens
KRLSLPMDIRLPQEFLQKLQMESPDLPKPLSRMSRRASLSDIGFGKLETYVKLDKLGEGTYATVFKGRSKLTENLVALKEIRLEHEEGAPCTAIREVSLLKNLKHANIVTLHDLIHTDRSLTLVFEYLDSDLKQYLDHCGNLMSMHNVKIFMFQLLRGLAYCHTRKILHRDLKPQNLLINERGELKLADFGLARAKSVPTKTYSNEVVTLWYRPPDVLLGSTEYSTPIAMWGVGCIHYEMATGRPLFPGSTVKEELHLIFRLLGTPTEETWPGVTAFSEFRTYSFPCYLPQPLINHAPRLDTDGIHLLSSLLVYESKSRMSAEAALSHSYFRSLGERVHQLEDTASIFSLKEIQLQKDPGYRGLAFQQPGRGKNRRQSIF

SEQ ID NO: 51 - DNA, 6574 bp, Homo sapiens
  CDS (19)...(6180)
agagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctctgatgaagattaagcacgtgagcaactttgtccggaagtattccgacaccatagctgagttacaggagctccagccttcggcaaaggacttcgaagtcagaagtcttgtaggttgtggtcactttgctgaagtgcaggtggtaagagagaaagcaaccggggacatctatgctatgaaagtgatgaagaagaaggctttattggcccaggagcaggtttcattttttgaggaagagcggaacatattatctcgaagcacaagcccgtggatcccccaattacagtatgcctttcaggacaaaaatcacctttatctgatggaggaatatcagcctggaggggacttgctgtcacttttgaatagatatgaggaccagttagatgaaaacctgatacagttttacctagctgagctgattttggctgttcacagcgttcatctgatgggatacgtgcatcgagacatcaagcctgagaacattctcgttgaccgcacaggacacatcaagctggtggattttggatctgccgcgaaaatgaattcaaacaagatggtgaatgccaaactcccgattgggaccccagattacatggctcctgaagtgctgactgtgatgaacggggatggaaaaggcacctacggcctggactgtgactggtggtcagtgggcgtgattgcctatgagatgatttatgggagatcccccttcgcagagggaacctctgccagaaccttcaataacattatgaatttccagcggtttttgaaatttccagatgaccccaaagtgagcagtgactttcttgatctgattcaaagcttgttgtgcggccagaaagagagactgaagtttgaaggtctttgctgccatcctttcttctctaaaattgactggaacaacattcgtaactctcctccccccttcgttcccaccctcaagtctgacgatgacacctccaattttgatgaaccagagaagaattcgtgggtttcatcctctccgtgccagctgagcccctcaggcttctcgggtgaagaactgccgtttgtggggttttcgtacagcaaggcactggggattcttggtagatctgagtctgttgtgtcgggtctggactcccctgccaagactagctccatggaaaagaaacttctcatcaaaagcaaagagctacaagactctcaggacaagtgtcacaagatggagcaggaaatgacccggttacatcggagagtgtcagaggtggaggctgtgcttagtcagaaggaggtggagctgaaggcctctgagactcagagatccctcctggagcaggaccttgctacctacatcacagaatgcagtagcttaaagcgaagtttggagcaagcacggatggaggtgtcccaggaggatgacaaagcactgcagcttctccatgatatcagagagcagagccggaagctccaagaaatcaaagagcaggagtaccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgcaaaggagcgagccgagagggagctggagaagctgcagaaccgagaggattcttctgaaggcatcagaaagaagctggtggaagctgaggaacgccgccattctctggagaacaaggtaaagagactagagaccatggagcgtagagaaaacagactgaaggatgacatccagacaaaatcccaacagatccagcagatggctgataaaattctggagctcgaagagaaacatcgggaggcccaagtctcagcccagcacctagaagtgcacctgaaacagaaagagcagcactatgaggaaaagattaaagtgttggacaatcagataaagaaagacctggctgacaaggagacactggagaacatgatgcagagacacgaggaggaggcccatgagaagggcaaaattctcagcgaacagaaggcgatgatcaatgctatggattccaagatcagatccctggaacagaggattgtggaactgtctgaagccaataaacttgcagcaaatagcagtctttttacccaaaggaacatgaaggcccaagaagagatgatttctgaactcaggcaacagaaattttacctggagacacaggctgggaagttggaggcccagaaccgaaaactggaggagcagctggagaagatcagccaccaagaccacagtgacaagaatcggctgctggaactggagacaagattgcgggaggtcagtctagagcacgaggagcagaaactggagctcaagcgccagctcacagagctacagctctccctgcaggagcgcgagtcacagttgacagccctgcaggctgcacgggcggccctggagagccagcttcgccaggcgaagacagagctggaagagaccacagcagaagctgaagaggagatccaggcactcacggcacatagagatgaaatccagcgcaaatttgatgctcttcgtaacagctgtactgtaatcacagacctggaggagcagctaaaccagctgaccgaggacaacgctgaactcaacaaccaaaacttctacttgtccaaacaactcgatgaggcttctggcgccaacgacgagattgtacaactgcgaagtgaagtggaccatctccgccgggagatcacggaacgagagatgcagcttaccagccagaagcaaacgatggaggctctgaagaccacgtgcaccatgctggaggaacaggtcatggatttggaggccctaaacgatgagctgctagaaaaagagcggcagtgggaggcctggaggagcgtcctgggtgatgagaaatcccagtttgagtgtcgggttcgagagctgcagagaatgctggacaccgagaaacagagcagggcgagagccgatcagcggatcaccgagtctcgccaggtggtggagctggcagtgaaggagcacaaggctgagattctcgctctgcagcaggctctcaaagagcagaagctgaaggccgagagcctctctgacaagctcaatgacctggagaagaagcatgctatgcttgaaatgaatgcccgaagcttacagcagaagctggagactgaacgagagctcaaacagaggcttctggaagagcaagccaaattacagcagcagatggacctgcagaaaaatcacattttccgtctgactcaaggactgcaagaagctctagatcgggctgatctactgaagacagaaagaagtgacttggagtatcagctggaaaacattcaggttctctattctcatgaaaaggtgaaaatggaaggcactatttctcaacaaaccaaactcattgattttctgcaagccaaaatggaccaacctgctaaaaagaaaaagggtttatttagtcgacggaaagaggaccctgctttacccacacaggttcctctgcagtacaatgagctgaagctggccctggagaaggagaaagctcgctgtgcagagctagaggaagcccttcagaagacccgcatcgagctccggtccgcccgggaggaagctgcccaccgcaaagcaacggaccacccacacccatccacgccagccaccgcgaggcagcagatcgccatgtccgccatcgtgcggtcgccagagcaccagcccagtgccatgagcctgctggccccgccatccagccgcagaaaggagtcttcaactccagaggaatttagtcggcgtcttaaggaacgcatgcaccacaatattcctcaccgattcaacgtaggactgaacatgcgagccacaaagtgtgctgtgtgtctggataccgtgcactttggacgccaggcatccaaatgtctcgaatgtcaggtgatgtgtcaccccaagtgctccacgtgcttgccagccacctgcggcttgcctgctgaatatgccacacacttcaccgaggccttctgccgtgacaaaatgaactccccaggtctccagaccaaggagcccagcagcagcttgcacctggaagggtggatgaaggtgcccaggaataacaaacgaggacagcaaggctgggacaggaagtacattgtcctggagggatcaaaagtcctcatttatgacaatgaagccagagaagctggacagaggccggtggaagaatttgagctgtgccttcccgacggggatgtatctattcatggtgccgttggtgcttccgaactcgcaaatacagccaaagcagaaaaagcagaagctgatgctaaactgcttggaaactccctgctgaaactggaaggtgatgaccgtctagacatgaactgcacgctgcccttcagtgaccaggtggtgttggtgggcaccgaggaagggctctacgccctgaatgtcttgaaaaactccctaacccatgtcccaggaattggagcagtcttccaaatttatattatcaaggacctggagaagctactcatgatagcaggagaagagcgggcactgtgtcttgtggacgtgaagaaagtgaaacagtccctggcccagtcccacctgcctgcccagcccgacatctcacccaacatttttgaagctgtcaagggctgccacttgtttggggcaggcaagattgagaacgggctctgcatctgtgcagccatgcccagcaaagtcgtcattctccgctacaacgaaaacctcagcaaatactgcatccggaaagagatagagacctcagagccctgcagctgtatccacttcaccaattacagtatcctcattggaaccaataaattctacgaaatcgacatgaagcagtacacgctcgaggaattcctggataagaatgaccattccttggcacctgctgtgtttgccgcctcttccaacagcttccctgtctcaatcgtgcaggtgaacagcgcagggcagcgagaggagtacttgctgtgtttccacgaatttggagtgttcgtggattcttacggaagacgtagccgcacagacgatctcaagtggagtcgcttacctttggcctttgcctacagagaaccctatctgtttgtgacccacttcaactcactcgaagtaattgagatccaggcacgctcctcagcagggacccctgcccgagcgtacctggacatcccgaacccgcgctacctgggccctgccatttcctcaggagcgatttacttggcgtcctcataccaggataaattaagggtcatttgctgcaagggaaacctcgtgaaggagtccggcactgaacaccaccggggcccgtccacctcccgcagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaagggaagagggcagagtgcctctcaagttttcacggttaacactgtcacctattatgactggaataaaaagctggacaacctgccagctaactggtcagtcctgaggatcatccagctgaatggagaaatccggcagcaggttgaaaagtctgttctgagaacagattattgctgagcagagttcatgtgacttctagacgtggtgacttaaaaaatggccttaaggctgcagagccagccacctctgcttacaaaaagagtacttagtgcacatgactgtaagaaacaattgtaaaacctcatctagaaatcagaaagcttctaatttctatagaaatgacacctccctggagccgagagacaatctgttgttgattttgaaggacaggcaagaccaacactgtatttagttccatagccaggcctcaacagggacaagtggctggccttaaaaacacacagatgactggaaatgatgtgtggcctcagtccctgtttcccagaattttactggcaaaggagttagcattcatttttggcttaagaaaaatcgagaatgtaggtttaga

SEQ ID NO: 52 - protein, 2053 aa, Homo sapiens
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLMEEYQPGGDLLSLLNRYEDQLDENLIQFYLAELILAVHSVHLMGYVHRDIKPENILVDRTGHIKLVDFGSAAKMNSNKMVNAKLPIGTPDYMAPEVLTVMNGDGKGTYGLDCDWWSVGVIAYEMIYGRSPFAEGTSARTFNNIMNFQRFLKFPDDPKVSSDFLDLIQSLLCGQKERLKFEGLCCHPFFSKIDWNNIRNSPPPFVPTLKSDDDTSNFDEPEKNSWVSSSPCQLSPSGFSGEELPFVGFSYSKALGILGRSESVVSGLDSPAKTSSMEKKLLIKSKELQDSQDKCHKMEQEMTRLHRRVSEVEAVLSQKEVELKASETQRSLLEQDLATYITECSSLKRSLEQARMEVSQEDDKALQLLHDIREQSRKLQEIKEQEYQAQVEEMRLMMNQLEEDLVSARRRSDLYESELRESRLAAEEFKRKATECQHKLLKAKDQGKPEVGEYAKLEKINAEQQLKIQELQEKLEKAAKERAERELEKLQNREDSSEGIRKKLVEAEERRHSLENKVKRLETMERRENRLKDDIQTKSQQIQQMADKILELEEKHREAQVSAQHLEVHLKQKEQHYEEKIKVLDNQIKKDLADKETLENMMQRHEEEAHEKGKILSEQKAMINAMDSKIRSLEQRIVELSEANKLAANSSLFTQRNMKAQEEMISELRQQKFYLETQAGKLEAQNRKLEEQLEKISHQDHSDKNRLLELETRLREVSLEHEEQKLELKRQLTELQLSLQERESQLTALQAARAALESQLRQAKTELEETTAEAEEEIQALTAHRDEIQRKFDALRNSCTVITDLEEQLNQLTEDNAELNNQNFYLSKQLDEASGANDEIVQLRSEVDHLRREITEREMQLTSQKQTMEALKTTCTMLEEQVMDLEALNDELLEKERQWEAWRSVLGDEKSQFECRVRELQRMLDTEKQSRARADQRITESRQVVELAVKEHKAEILALQQALKEQKLKAESLSDKLNDLEKKHAMLEMNARSLQQKLETERELKQRLLEEQAKLQQQMDLQKNHIFRLTQGLQEALDRADLLKTERSDLEYQLENIQVLYSHEKVKMEGTISQQTKLIDFLQAKMDQPAKKKKGLFSRRKEDPALPTQVPLQYNELKLALEKEKARCAELEEALQKTRIELRSAREEAAHRKATDHPHPSTPATARQQIAMSAIVRSPEHQPSAMSLLAPPSSRRKESSTPEEFSRRLKERMHHNIPHRFNVGLNMRATKCAVCLDTVHFGRQASKCLECQVMCHPKCSTCLPATCGLPAEYATHFTEAFCRDKMNSPGLQTKEPSSSLHLEGWMKVPRNNKRGQQGWDRKYIVLEGSKVLIYDNEAREAGQRPVEEFELCLPDGDVSIHGAVGASELANTAKAEKAEADAKLLGNSLLKLEGDDRLDMNCTLPFSDQVVLVGTEEGLYALNVLKNSLTHVPGIGAVFQIYIIKDLEKLLMIAGEERALCLVDVKKVKQSLAQSHLPAQPDISPNIFEAVKGCHLFGAGKIENGLCICAAMPSKVVILRYNENLSKYCIRKEIETSEPCSCIHFTNYSILIGTNKFYEIDMKQYTLEEFLDKNDHSLAPAVFAASSNSFPVSIVQVNSAGQREEYLLCFHEFGVFVDSYGRRSRTDDLKWSRLPLAFAYREPYLFVTHFNSLEVIEIQARSSAGTPARAYLDIPNPRYLGPAISSGAIYLASSYQDKLRVICCKGNLVKESGTEHHRGPSTSRSSPNKRGPPTYNEHITKRVASSPAPPEGPSHPREPSTPHRYREGRTELRRDKSPGRPLEREKSPGRMLSTRRERSPGRLFEDSSRGRLPAGAVRTPLSQVNKGRGQSASQVFTVNTVTYYDWNKKLDNLPANWSVLRIIQLNGEIRQQVEKSVLRTDYC

SEQ ID NO: 53 - DNA, 6220 bp, Homo sapiens
  CDS (446)...(4957)
tgtgcagaattgtacagttgcgaaaccatgtcgctggcagctggtgctggcggtggagacttccctgtgcggtgctcagtgcatctgcacccgtgggggagggagctctttctctggccctgcagtcacctgaggttgttaccattatgaacggccgctgggacccccgcatgtgcatgtactcccccagagtgtccgggggccccagccaagggacacatctcacgcagctgggaacatgtgcaggctgatgaagagaaccggatgagggcttcacatgaggaagcatgtggccaggtcctctcagaacatcagcctcatcttcctgtctctgatctatttcaccaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatattgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggaaaacggggtgcagctgaaggagtttgtcacctgggacaccttgctctacctgtacgagaacctggacccctcctgcctgttccacagcaagctgcaaaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccgagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcgggatcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccagtat

SEQ ID NO: 54 - protein, 1503 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 55 - DNA, 3069 bp, Homo sapiens
  CDS (421)...(1770)
attccggcgggcggcgcttggttagcaggtggacaggcgtcctctttccggctgttgctgctcttcttcctccaatcctgggtctcagtcagggaagaacgaacattcttcctttgctgctggagcttttagagaactgttgcccagcaccttaggcacttcagacatttcatctcactcatttttgtaatttcactgtaaaaatcacctgcacatttataacactgtgactctccacttctgctcaatgctgaaaaggggtccgcatactgcggggagctgtctaaggtgctgaagcttcccaagcatcagtctacaccaacaccatgcggggttagattgtacattttcattctgtctttctggttccccatgccttggataagactattttcaggatcgtgaatatctctccgtatcatggcccacgtgagacactttcggacattagtttcgggattttacttctgggaagcagcactgttactcagtttggttgccacaaaggaaacagacagtgcaagatctcgaagtgctccaatgtcaccttctgattttctggataaattaatgggcaggacatcaggatatgatgcaagaatcagacccaattttaaaggccctccagttaatgtcacatgcaacatattcatcaacagtttcggctctatcgcagagacgaccatggattacagagtgaatatctttcttcgtcagaaatggaatgatccccgcctcgcgtacagtgaatatcctgacgactctttagacctcgacccctccatgttggactccatttggaaacctgatttgttctttgccaatgaaaagggtgccaactttcatgaagtcactacagacaacaaattgctaagaattttcaaaaatggaaatgttctttattcaataagattaacattaacactttcctgtccaatggatctcaagaattttcccatggatgtacaaacatgtataatgcaactggaaagctttgggtacacaatgaatgatctcatttttgaatggcaagatgaggcacccgtacaagtggcagaaggactcactttgccccagtttctgttgaaagaagaaaaagatttacgatactgcactaaacattacaatacaggaaagtttacgtgtatagaagtgcgattccatctggagcgacaaatgggatactatctgatccagatgtacattcccagtctcctgattgttattctatcctgggtttcgttctggatcaacatggatgcagcaccggccagggtagctctggggataaccaccgtgctaacgatgactacacagagttcaggatcacgagcttccttgccaaaagtttcatatgtcaaagctattgatatttggatggcagtatgcctcctttttgtgttttcagcacttctggagtatgcagctgtaaattttgtatcaagacaacacaaagaacttctgagatttcgacgaaagagaaagaataaggatgatgaggtaagggaaagccgattcagcttcacagcctatggaatgggaccatgtctacaagcaaaggatggcatgactccaaagggccccaaccaccctgtccaggtaatgccaaaaagtcctgatgaaatgaggaaggtctttatcgaccgggccaagaagattgataccatctcccgagcctgcttcccattagcttttttgatttttaatattttctactgggttatctataaaattcttaggcatgaggatattcatcagcagcaagattaagtctctgggggcatgcaaatgcaaatggtcaattcagaagaaagtgtctctgccataggtgtgtatgtgtatatgtgtgcgtgtggtatacaaatgatgaccattgtattaaaatggcatatggaaaagctttgtattttggttagctatgcaaagtcatgagaaagatgagattcttttaatgaatataaaatatttattaggggattctatttcatattaattccaggtgatttgttttttcacagtaaaccatgtaagtggaagctttactgccaatgtgtttatatgttatataatatctcataatagtagacatgaaaactactttgaaattccttgatttgtaattcaatgctattaaatcatacaaaagcaaattttgcacagtaaactaatagtttgagatttaaaactattttcttatagtatagttacaaaatgggaaaataattagttacagtgggaaattcactcatattaatggaggattgtacatataaatactatttaaacaacatatgtaattttgaaaatttttaaataagagcattaaaagactttaatgatttggaatactaaatttaattgtttagaatattaagttttcctctgtgcaaatttaaaacaaataacaagagatcgtgttacagtcacaatctacttttcttaaactttgtatctctaggaacgaaggtggaaatacgggaaacaactttgtttttaaataagtattatagctatgtatttttagttattgccaaacattgaacaattcaagccagcacccttgtttttgttagacttttaatagctacttaactgtatgtgattgtgtttaataatttgatataacaggacaaaattcagtaagacttttatattttagtttagaatgtgactttaaaattcaatgggattaaagtatttacattttgataaaaatgaatacaatgaaaacaaaatggattcatggaagattttttaataaaaaccattttcccatcaatgttttatgggtctcaactcctatctccaaatataagtagggaaagttttaattttaaatgatataagtaagtcatttctataaagtgaggactctttttctatttctgaattaatgatttcaaaatctaagccattcgcaagatgtgaataattttaaatgaaatttttacataaaatttttcaatgaccccatgggattacttcaacaaaaacagagcattagtaacttgttttttgcagtgtaattgggtgcaaatgtatgatagagttcttggtaaacagaaccag

SEQ ID NO: 56 - protein, 449 aa, Homo sapiens
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 57 - DNA, 3164 bp, Homo sapiens
  CDS (1)...(2877)
atgccggtccgcaggggccacgtcgctccccaaaacacttacctggacaccatcatccgcaagttcgagggccaaagtcggaagttcctgattgccaatgctcagatggagaactgcgccatcatttactgcaacgacggcttctgcgaactcttcggctactcccgagtggaggtgatgcagcaaccctgcacctgcgacttcctcacaggccccaacacaccaagcagcgccgtgtcccgcctagcgcaggccctgctgggggctgaggagtgcaaggtggacatcctctactaccgcaaggatgcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccgagggctctcatggcaggccaggcggaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacgccctactcagccgccttcctgctcagcgaccaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaagggctggttcctcattgacatggtggccgccatccctttcgacctcctgatcttccgcactggctccgatgagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctccctgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggaaagaatgacatctttggggaacccgtcagcctccatgcccagccaggcaagtccagtgcagacgtgcgggctctgacctactgcgacctgcacaagatccagcgggcagatctgctggaggtgctggacatgtacccggcctttgcggagagcttctggagtaagctggaggtcaccttcaacctgcgggacgcagccgggggtctccactcatccccccgacaggctcctggcagccaagaccaccaaggtttctttctcagtgacaaccagtcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacagaccccaagctatggagacttggatgactgtagtccaaagcacaggaactcctcccccaggatgcctcacctggctgtggcaacggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggggatttcctttagctgggcatggtggcgggcgcctgtaatcccagctactcaggaggctgaagcaagagaatcacttgaaccctaaaggcagaggttgcagtgagccgagatagtgccactgcactacagcccgggcgacagagtgagactccatctcaaaaataaaataaaaaaaaaaaaaaaaaaaaaaaaaaaaaaaaaaaaaaaaaaaaaaaaaaaaaaaaaaaaaaaaaaaaaaaaaa

SEQ ID NO: 58 - protein, 958 aa, Homo sapiens
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 59 - DNA, 2421 bp, Homo sapiens
  CDS (91)...(2058)
ccagcagccaagagggtagtggtgtaccggaatggggacccattcttcccaggctcccagctggtggtgactcaacgccgcttccccaccatggaggccttcctctgcgaggtgacatcagctgtgcaggccccactggctgtgcgtgccctctacacaccttgtcatggccaccctgtcaccaacctggcagacttgaagaacagagggcagtatgtggccgctggatttgaacgattccacaagctccccccttaccaggctttttgtctcagtgtgttcaggaatggggacctggtaagtcccccatttagtctgaagctgtcccaggctgccagccaggactgggaaactgtgttgaagctcctgactgagaaggtcaagttgcagagtggggctgtgagactctgcaccctagaggggctcccactgtcagcagggaaggagctggtaactggccattactatgtggctgtcggagaggatgagttcaaggaccttccctatccagctctgtccacaagagggctcctggcagcaggcaatgaagcccacctgaggagtggagtggggactgtcgctggttcccccaagcctcttggaaggaaggctaagaaggagacatgcctaatcgtgaccctgaccctgaaataccagcagtcagaaacaagcagagacgggcaatcattcccatcaggagttataggagtatatggagctccccaccgaaggaaggagacagcgggggccctggaagtagcagatgatgaagacactcagacagaggagcccttggatcagagggcagcacagatagtggaacaggttacttgtctgcaagacttttttggtgatgacgatgtttttattgcatgtggaccagaaaaatttcgttatgcccaagatgactttgtcctggatcatagtcgtcgacggctcctgagagagcaccaggcgggctttgagaagctccgcaggacccgaggagaagagaaggaggcagagaaggagaaaaagccatgtatgtctggaggcagaaggatgactctcagagatgaccaacctgcaaagctagaaaaggagcccaagacgaggccagaagagaacaagccagagcggcccagcggtcggaagccacggcccatgggcatcattgccgccaatgtggaaaagcattatgagactggccgggtcattggggatgggaactttgctgtcgtgaaggagtgcagacaccgcgagaccaggcaggcctatgcgatgaagatcattgacaagtccagactcaagggcaaggaggacatggtggacagtgagatcttgatcatccagagcctctctcaccccaacatcgtgaaattgcatgaagtctacgaaacagacatggaaatctacctgatcctggagtacgtgcagggaggagacctttttgacgccatcatagaaagtgtgaagttcccggagcccgatgctgccctcatgatcatggacttatgcaaagccctcgtccacatgcacgacaagagcattgtccaccgggacctcaagccggaaaaccttttggttcagcgaaatgaggacaaatctactaccttgaaattggctgattttggacttgcaaagcatgtggtgagacctatatttactgtgtgtgggaccccaacttacgtagctcccgaaattctttctgagaaaggttatggactggaggtggacatgtgggctgctggcgtgatcctctatatcctgctgtgtggctttcccccattccgcagccctgagagggaccaggacgagctctttaacatcatccagctgggccactttgagttcctccccccttactgggacaatatctctgatgctgctaaagatctggtgagccggttgctggtggtagaccccaaaaagcgctacacagctcatcaggttcttcagcacccctggatcgaaacagctggcaagaccaatacagtgaaacgacagaagcaggtgtcccccagcagcgatggtcacttccggagccagcacaagagggttgtggagcaggtatcatagtcaccaccttgggaatctgtccagcccccagttctgctcaaggacagagaaaaggatagaagtttgagagaaaaacaatgaaagaggcttcttcacataattggtgaatcagagggagagacactgagtatattttaaagcatattaaaaaaattaagtcaatgttaaatgtcacaacatatttttagatttgtatatttaaagcctttaatacatttttggggggtaagcattgtcatcagtgaggaattttggtaataatgatgtgttttgcttcccctttgtaaccaagtttattctgtactacaggagtggtgcttaccagggtctaaactccccctgtgagattaataaggtgcattg

SEQ ID NO: 60 - protein, 655 aa, Homo sapiens
MEAFLCEVTSAVQAPLAVRALYTPCHGHPVTNLADLKNRGQYVAAGFERFHKLPPYQAFCLSVFRNGDLVSPPFSLKLSQAASQDWETVLKLLTEKVKLQSGAVRLCTLEGLPLSAGKELVTGHYYVAVGEDEFKDLPYPALSTRGLLAAGNEAHLRSGVGTVAGSPKPLGRKAKKETCLIVTLTLKYQQSETSRDGQSFPSGVIGVYGAPHRRKETAGALEVADDEDTQTEEPLDQRAAQIVEQVTCLQDFFGDDDVFIACGPEKFRYAQDDFVLDHSRRRLLREHQAGFEKLRRTRGEEKEAEKEKKPCMSGGRRMTLRDDQPAKLEKEPKTRPEENKPERPSGRKPRPMGIIAANVEKHYETGRVIGDGNFAVVKECRHRETRQAYAMKIIDKSRLKGKEDMVDSEILIIQSLSHPNIVKLHEVYETDMEIYLILEYVQGGDLFDAIIESVKFPEPDAALMIMDLCKALVHMHDKSIVHRDLKPENLLVQRNEDKSTTLKLADFGLAKHVVRPIFTVCGTPTYVAPEILSEKGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSDGHFRSQHKRVVEQVS

SEQ ID NO: 61 - DNA, 1547 bp, Homo sapiens
  CDS (58)...(1290)
cggctgcccggagtctgggcgagctgcctgggagggagcgccggccgcgggagcgggatggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgtgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcaaaatgaccagctgcttagtcacctggcaaagcaggtgagcaacctcatcactaatcattcaagcttcgcagccagggcgacttctatcaaccccagctctgctgagaaccatcaagcgcagggaagccacgtgacccctcctagcctcaggctccctcgtctgtgtagtggagataaagaacagcacccatctcttagtgttgcctgagactaaagtgcccggaattc

SEQ ID NO: 62 - protein, 410 aa, Homo sapiens
METSSPRPPRPSSNPGLSLDARLGVDTRLWAKVLFTALYALIWALGAAGNALSVHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 63 - DNA, 3278 bp, Homo sapiens
  CDS (482)...(3001)
ccacgcgtccgaaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagttcccaagttttcccttgtgcattgttctgagcagtgtgatggagagtctctgccgtgccatctgggatgcaaaccgtccctgtgtcccccacgtccaggccgtagatgctccccgccggtcagtcacttagtcgtcagatcgcccgtcctggtatcacagtgcttctgttcaggttgcacactgggccacagaggatccagcaaggatgaagaaatggagcagcacagacttggggacagctgcggacccactccaaaaggacacctgcccagaccccctggatggagaccctaactccaggccacctccagccaagccccagctccccacggccaagagccgcacccggctctttgggaagggtgactcggaggaggctttcccggtggattgcccccacgaggaaggtgagttggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaacaactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaattggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaaaaaaaaaaaaaaagggcggccgctta

SEQ ID NO: 64 - protein, 839 aa, Homo sapiens
MKKWSSTDLGTAADPLQKDTCPDPLDGDPNSRPPPAKPQLPTAKSRTRLFGKGDSEEAFPVDCPHEEGELDSCPTITVSPVITIQRPGDGPTGARLLSQDSVAASTEKTLRLYDRRSIFEAVAQNNCQDLESLLLFLQKSKKHLTDNEFKDPETGKTCLLKAMLNLHDGQNTTIPLLLEIARQTDSLKELVNASYTDSYYKGQTALHIAIERRNMALVTLLVENGADVQAAAHGDFFKKTKGRPGFYFGELPLSLAACTNQLGIVKFLLQNSWQTADISARDSVGNTVLHALVEVADNTADNTKFVTSMYNEILMLGAKLHPTLKLEELTNKKGMTPLALAAGTGKIGVLAYILQREIQEPECRHLSRKFTEWAYGPVHSSLYDLSCIDTCEKNSVLEVIAYSSSETPNRHDMLLVEPLNRLLQDKWDRFVKRIFYFNFLVYCLYMIIFTMAAYYRPVDGLPPFKMEKIGDYFRVTGEILSVLGGVYFFFRGIQYFLQRRPSMKTLFVDSYSEMLFFLQSLFMLATVVLYFSHLKEYVASMVFSLALGWTNMLYYTRGFQQMGIYAVMIEKMILRDLCRFMFVYIVFLFGFSTAVVTLIEDGKNDSLPSESTSHRWRGPACRPPDSSYNSLYSTCLELFKFTIGMGDLEFTENYDFKAVFIILLLAYVILTYILLLNMLIALMGETVNKIAQESKNIWKLQRAITILDTEKSFLKCMRKAFRSGKLLQVGYTPDGKDDYRWCFRVDEVNWTTWNTNVGIINEDPGNCEGVKRTLSFSLRSSRVSGRHWKNFALVPLLREASARDRQSAQPEEVYLRQFSGSLKPEDAEVFKSPAASGEK

SEQ ID NO: 65 - DNA, 3884 bp, Homo sapiens
  CDS (171)...(2909)
ccgagtgacaaggaggtgggagagggtagcagcatgggctacgcggttggctgccctcagtccccctgctgctgaagctgccctgcccatgcccacccaggccgtggggccaggggcctgccagggctaggagtgggcctgccgttcatgggtctctagggatttccgagatgcctgggaagagaggcttgggctggtggtgggcccggctgcccctttgcctgctcctcagcctttacggcccctggatgccttcctccctgggaaagcccaaaggccaccctcacatgaattccatccgcatagatggggacatcacactgggaggcctgttcccggtgcatggccggggctcagagggcaagccctgtggagaacttaagaaggaaaagggcatccaccggctggaggccatgctgttcgccctggatcgcatcaacaacgacccggacctgctgcctaacatcacgctgggcgcccgcattctggacacctgctccagggacacccatgccctcgagcagtcgctgacctttgtgcaggcgctcatcgagaaggatggcacagaggtccgctgtggcagtggcggcccacccatcatcaccaagcctgaacgtgtggtgggtgtcatcggtgcttcagggagctcggtctccatcatggtggccaacatccttcgcctcttcaagataccccagatcagctacgcctccacagcgccagacctgagtgacaacagccgctacgacttcttctcccgcgtggtgccctcggacacgtaccaggcccaggccatggtggacatcgtccgtgccctcaagtggaactatgtgtccacagtggcctcggagggcagctatggtgagagcggtgtggaggccttcatccagaagtcccgtgaggacgggggcgtgtgcatcgcccagtcggtgaagataccacgggagcccaaggcaggcgagttcgacaagatcatccgccgcctcctggagacttcgaacgccagggcagtcatcatctttgccaacgaggatgacatcaggcgtgtgctggaggcagcacgaagggccaaccagacaggccatttcttctggatgggctctgacagctggggctccaagattgcacctgtgctgcacctggaggaggtggctgagggtgctgtcacgatcctccccaagaggatgtccgtacgaggcttcgaccgctacttctccagccgcacgctggacaacaaccggcgcaacatctggtttgccgagttctgggaggacaacttccactgcaagctgagccgccacgccctcaagaagggcagccacgtcaagaagtgcaccaaccgtgagcgaattgggcaggattcagcttatgagcaggaggggaaggtgcagtttgtgatcgatgccgtgtacgccatgggccacgcgctgcacgccatgcaccgtgacctgtgtcccggccgcgtggggctctgcccgcgcatggaccctgtagatggcacccagctgcttaagtacatccgaaacgtcaacttctcaggcatcgcagggaaccctgtgaccttcaatgagaatggagatgcgcctgggcgctatgacatctaccaataccagctgcgcaacgattctgccgagtacaaggtcattggctcctggactgaccacctgcaccttagaatagagcggatgcactggccggggagcgggcagcagctgccccgctccatctgcagcctgccctgccaaccgggtgagcggaagaagacagtgaagggcatgccttgctgctggcactgcgagccttgcacagggtaccagtaccaggtggaccgctacacctgtaagacgtgtccctatgacatgcggcccacagagaaccgcacgggctgccggcccatccccatcatcaagcttgagtggggctcgccctgggccgtgctgcccctcttcctggccgtggtgggcatcgctgccacgttgttcgtggtgatcacctttgtgcgctacaacgacacgcccatcgtcaaggcctcgggccgtgaactgagctacgtgctgctggcaggcatcttcctgtgctatgccaccaccttcctcatgatcgctgagcccgaccttggcacctgctcgctgcgccgaatcttcctgggactagggatgagcatcagctatgcagccctgctcaccaagaccaaccgcatctaccgcatcttcgagcagggcaagcgctcggtcagtgccccacgcttcatcagccccgcctcacagctggccatcaccttcagcctcatctcgctgcagctgctgggcatctgtgtgtggtttgtggtggacccctcccactcggtggtggacttccaggaccagcggacactcgacccccgcttcgccaggggtgtgctcaagtgtgacatctcggacctgtcgctcatctgcctgctgggctacagcatgctgctcatggtcacgtgcaccgtgtatgccatcaagacacgcggcgtgcccgagaccttcaatgaggccaagcccattggcttcaccatgtacaccacttgcatcgtctggctggccttcatccccatcttctttggcacctcgcagtcggccgacaagctgtacatccagacgacgacgctgacggtctcggtgagtctgagcgcctcggtgtccctgggaatgctctacatgcccaaagtctacatcatcctcttccacccggagcagaacgtgcccaagcgcaagcgcagcctcaaagccgtcgttacggcggccaccatgtccaacaagttcacgcagaagggcaacttccggcccaacggagaggccaagtctgagctctgcgagaaccttgaggccccagcgctggccaccaaacagacttacgtcacttacaccaaccatgcaatctagcgagtccatggagctgagcagcaggaggaggagccgtgaccctgtggaaggtgcgtcgggccagggccacacccaagggcccagctgtcttgcctgcccgtgggcacccacggacgtggcttggtgctgaggatagcagagcccccagccatcactgctggcagcctgggcaaaccgggtgagcaacaggaggacgaggggccggggcggtgccaggctaccacaagaacctgcgtcttggaccattgcccctcccggccccaaaccacaggggctcaggtcgtgtgggccccagtgctagatctctccctcccttcgtctctgtctgtgctgttggcgacccctctgtctgtctccagccctgtctttctgttctcttatctctttgtttcaccttttccctctctggcgtccccggctgcttgtactcttggccttttctgtgtctcctttctggctcttgcctccgcctctctctctcatcctctttgtcctcagctcctcctgctttcttgggtcccaccagtgtcacttttctgccgttttctttcctgttctcctctgcttcattctcgtccagccattgctcccctctccctgccacccttccccagttcaccaaaccttacatgttgcaaaagagaaaaaaggaaaaaaaatcaaaacacaaaaaagccaaaacgaaaacaaatctcgagtgtgttgccaagtgctgcgtcctcctggtggcctctgtgtgtgtccctgtggcccgcagcctgcccgcctgccccgcccatctgccgtgtgtcttgcccgcctgccccgcccgtctgccgtctgtcttgcccgcctgcccgcctgcccctcctgccgaccacacggagttcagtgcctgggtgtttggtgatggttattgacgacaatgtgtagcgcatgattgtttttataccaagaacatttctaataaaaataaacacatggttttgcaaaaaa

SEQ ID NO: 66 - protein, 912 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 67 - DNA, 3103 bp, Homo sapiens
  CDS (442)...(2634)
  misc_feature (1)...(3103): n = A,T,C or G
actatagggagtcgacccacgcgtccgccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagttttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggattttttttttaagtacctttggtgnattttcaaatatttctatctcttaaaaaaatggtattaccctcagtttctaataatttctggggtttagtagtgttgacaattaaaaatggnatacattaaaatttataagtttgccttcaggggtaactttccagtgncacaatggagcagttctgtaagtggggtgccctctcagcacatttctattgaatatattatgga

SEQ ID NO: 68 - protein, 730 aa, Homo sapiens
MPKNSKVVKRELDDDVTESVKDLLSNEDAADDAFKTSELIVDGQEEKDTDVEEGSEVEDERPAWNSKLQYILAQVGFSVGLGNVWRFPYLCQKNGGGAYLLPYLILLMVIGIPLFFLELSVGQRIRRGSIGVWNYISPKLGGIGFASCVVCYFVALYYNVIIGWSLFYFSQSFQQPLPWDQCPLVKNASHTFVEPECEQSSATTYYWYREALNISSSISESGGLNWKMTICLLAAWVMVCLAMIKGIQSSGKIIYFSSLFPYVVLICFLIRAFLLNGSIDGIRHMFTPKLEIMLEPKVWREAATQVFFALGLGFGGVIAFSSYNKRDNNCHFDAVLVSFINFFTSVLATLVVFAVLGFKANVINEKCITQNSETIMKFLKMGNISQDIIPHHINLSTVTAEDYHLVYDIIQKVKEEEFPALHLNSCKIEEELNKAVQGTGLAFIAFTEAMTHFPASPFWSVMFFLMLVNLGLGSMFGTIEGIVTPIVDTFKVRKEILTVICCLLAFCIGLIFVQRSGNYFVTMFDDYSATLPLLIVVILENIAVCFVYGIDKFMEDLKDMLGFAPSRYYYYMWKYISPLMLLSLLIASVVNMGLSPPGYNAWIEDKASEEFLSYPTWGLVVCVSLVVFAILPVPVVFIVRRFNLIDDSSGNLASVTYKRGRVLKEPVNLEGDDTSLIHGKIPSEMPSPNFGKNIYRKQSGSPTLDTAPNGRYGIGYLMADIMPDMPESDL

SEQ ID NO: 69 - DNA, 3552 bp, Homo sapiens
  CDS (208)...(2508)
ctcggcgctgcggacacttttagctgagggcgcgggcgggtcggctcctccgcggctcctcggccccacctgcgcggagagggcgggatgccagagccaggtgtcccggcgcgttaagggccctcgcagtcagacgtccctgcaccggcgctcgcacccttagtcggcccggaacgtctttttgcggacgccctcggagcagccgcgatggccagcaccaggagtatcgagctggagcactttgaggaacgggacaaaaggccgcggccggggtcgcggagaggggcccccagctcctccgggggcagcagcagctcgggccccaaggggaacgggctcatccccagtccggcgcacagtgcccactgcagcttctaccgcacgcggaccctgcaggccctcagctcggagaagaaggccaagaaggcgcgcttctaccggaacggggaccgctacttcaagggcctggtgtttgccatctccagcgaccgcttccggtccttcgatgcgctcctcatagagctcacccgctccctgtcggacaacgtgaacctgccccagggtgtccgcactatctacaccatcgacggcagccggaaggtcaccagcctggacgagctgctggaaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtgaatgtcgtgtcctgaagtcatcttattctcgatcctcagctgttaagtattctggatccaaaagccctgggccctctcgacgcagcaaatcaccagcttcagttaatggaactcccagcagccaactttctactcctaaatctacgaaatcctccagttcctctccaactagtccaggaagtttcagaggattaaagcagatttctgctcatggcagatcttcttccaatgtaaccggtggacctgagcttgaccgttgcataagtcctgaaggtgtgaatggaaacagatgctctgaatcatcaactcttcttgagaaatacaaaattggaaaggtcattggtgatggcaattttgcagtagtcaaagagtgtatagacaggtccactggaaaggagtttgccctaaagattatagacaaagccaaatgttgtggaaaggaacacctgattgagaatgaagtgtcaatactgcgccgagtgaaacatcccaatatcattatgctggtcgaggagatggaaacagcaactgagctctttctggtgatggaattggtcaaaggtggagatctctttgatgcaattacttcgtcgaccaagtacactgagagagatggcagtgccatggtgtacaacttagccaatgccctcaggtatctccatggcctcagcatcgtgcacagagacatcaaaccagagaatctcttggtgtgtgaatatcctgatggaaccaagtctttgaaactgggagactttgggcttgcgactgtggtagaaggccctttatacacagtctgtggcacacccacttatgtggctccagaaatcattgctgaaactggctatggcctgaaggtggacatttgggcagctggtgtgatcacatacatacttctctgtggattcccaccattccgaagtgagaacaatctccaggaagatctcttcgaccagatcttggctgggaagctggagtttccggccccctactgggataacatcacggactctgccaaggaattaatcagtcaaatgcttcaggtaaatgttgaagctcggtgtaccgcgggacaaatcctgagtcacccctgggtgtcagatgatgcctcccaggagaataacatgcaagctgaggtgacaggtaaactaaaacagcactttaataatgcgctccccaaacagaacagcactaccaccggggtctccgtcatcatgaacacggctctagataaggaggggcagattttctgcagcaagcactgtcaagacagcggcaggcctgggatggagcccatctctccagttcctccctcagtggaggagatccctgtgcctggggaagcagtcccggcccccacccctccggaatctcccaccccccactgtcctcccgctgccccgggtggtgagcgggcaggaacctggcgccgccaccgagactgagcctcctgcagacgggcgaagccgcctgctgccgcccaggaagccagccctctgctcggcctcgccggcctccctgctgcaggcctccctctcttcaccgcctgcgcctgagttcgcgggtcctccgcaggccgcctgggaaccggagcctggcgtgccggagcctggcctggtgctctgggctctgccttctggttcctggaggcatcaaaggctgcatccgttctgccaacagctgttcggagagactcgttccagatcatcccgtcattttcagtttgttggacattttacagcttcaccaggagaatgtgcaactttattccagcattcgatgcatttttatagaaacactttggaaacactttggatgaaccaaggccttttccttatttaagtagactcagaacactccctttcttttcttttctctctctctcttttttttttacgaaagacttagaattgcatttgtccttttgtgggtgtcctgtgagaggtgatatgggggctaagaggactggctttctaatagaagaagtgagcgcctgagaggacaatttggtcattggacacggattgcaggctttgagaagcgctcagaggcccagggcggcgggctcagccattcggcttggggcaccaggctccccagagacaatgctcagtattcattcatacacagacgatggaagaagccacttcttccctgggcggtgtgggtttcccccagctcttcccacacgtgtgttaggaaatgcccgtgaacttgccctctgggctttttaatgagaggcttggcgcatgcggcacccagcggctgcttccctgcaagccagcgacttgccgagcagaatgagctctgctcctgagccccggtagctgcttcctcatctgctctttttaataattgtacataatccgtgtatttgttttacctgctcatcttctaaactggcgagccctatagttcgttctcattgttagattttgccttttacaagtgtccccaacctgcaataaacttttccctcttgaaaaaaa

SEQ ID NO: 70 - protein, 766 aa, Homo sapiens
MASTRSIELEHFEERDKRPRPGSRRGAPSSSGGSSSSGPKGNGLIPSPAHSAHCSFYRTRTLQALSSEKKAKKARFYRNGDRYFKGLVFAISSDRFRSFDALLIELTRSLSDNVNLPQGVRTIYTIDGSRKVTSLDELLEGESYVCASNEPFRKVDYTKNINPNWSVNIKGGTSRALAAASSVKSEVKESKDFIKPKLVTVIRSGVKPRKAVRILLNKKTAHSFEQVLTDITEAIKLDSGVVKRLCTLDGKQVTCLQDFFGDDDVFIACGPEKFRYAQDDFVLDHSECRVLKSSYSRSSAVKYSGSKSPGPSRRSKSPASVNGTPSSQLSTPKSTKSSSSSPTSPGSFRGLKQISAHGRSSSNVTGGPELDRCISPEGVNGNRCSESSTLLEKYKIGKVIGDGNFAVVKECIDRSTGKEFALKIIDKAKCCGKEHLIENEVSILRRVKHPNIIMLVEEMETATELFLVMELVKGGDLFDAITSSTKYTERDGSAMVYNLANALRYLHGLSIVHRDIKPENLLVCEYPDGTKSLKLGDFGLATVVEGPLYTVCGTPTYVAPEIIAETGYGLKVDIWAAGVITYILLCGFPPFRSENNLQEDLFDQILAGKLEFPAPYWDNITDSAKELISQMLQVNVEARCTAGQILSHPWVSDDASQENNMQAEVTGKLKQHFNNALPKQNSTTTGVSVIMNTALDKEGQIFCSKHCQDSGRPGMEPISPVPPSVEEIPVPGEAVPAPTPPESPTPHCPPAAPGGERAGTWRRHRD

SEQ ID NO: 71 - DNA, 2305 bp, Homo sapiens
  CDS (280)...(1308)
atggacttatttcggaaaccgtccgtagctttgagtccagtgtttgaagacaatctctgattgtgaagccctctttttctctccttctatttctctctagagcactcaagactttactgacgaaaactcaggaaatcctctatcacaaagaggtttggcaactaaactaagacattaaaaggaaaataccagatgccactctgcaggctgcaataactactacttactggatacattcaaaccctccagaatcaacagttatcaggtaaccaacaagaaatgcaagccgtcgacaacctcacctctgcgcctgggaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccaaaaatctcttgggggctaagattctctctgttgtcatctgggcattcatgttcttactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaaccaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattacctgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaaggaagaacgatcaattggatataatttcttaccaaaaatgatagttaaaatgtatatatatcctagtcccctaaccaaatcctgacctattgggatacttataaaaatttaagtaagtgggatacacaaagaataataactattaacttttcattattagcaaaaacctaagggatttaaactaattgaaactgtatttgattggacttaattttttatgtttatttagaagataaagatttaaagaagacctttacaataaagagaagaaatatcgaagtcattaaaataaggagacttacttttatgacattctaatactaaraaatatagaaatatttccttaattctagagaaactagttttactaattttttacaacttcaataataccatcactgacacttacctttattaattagcttctagaaaatagctgctaattaggttaatgaacattttaccttagtgaaaaaaattaattaaatatgattacaaagttgcacagcataactactgagaggaaagtgattgatctgtttgtaattacttgtttgtattggtgtgtataaaatacaaaatttacattaaactctaaaaaaaaaaaaaaaaaaaaaaaaarggssgg

SEQ ID NO: 72 - protein, 342 aa, Homo sapiens
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 73 - DNA, 4052 bp, Homo sapiens
  CDS (45)...(1199)
agccgcagagcgcacagaaaggaggcgccgagacagacatcaccatggcagcccagaatggaaacaccagtttcacacccaactttaatccaccccaagaccatgcctcctccctctcctttaacttcagttatggtgattatgacctccctatggatgaggatgaggacatgaccaagacccggaccttcttcgcagccaagatcgtcattggcattgcactggcaggcatcatgctggtctgcggcatcggtaactttgtctttatcgctgccctcacccgctataagaagttgcgcaacctcaccaatctgctcattgccaacctggccatctccgacttcctggtggccatcatctgctgccccttcgagatggactactacgtggtacggcagctctcctgggagcatggccacgtgctctgtgcctccgtcaactacctgcgcaccgtctccctctacgtctccaccaatgccttgctggccattgccattgacagatatctcgccatcgttcaccccttgaaaccacggatgaattatcaaacggcctccttcctgatcgccttggtctggatggtgtccattctcattgccatcccatcggcttactttgcaacagaaaccgtcctctttattgtcaagagccaggagaagatcttctgtggccagatctggcctgtggatcagcagctctactacaagtcctacttcctcttcatctttggtgtcgagttcgtgggccctgtggtcaccatgaccctgtgctatgccaggatctcccgggagctctggttcaaggcagtccctgggttccagacggagcagattcgcaagcggctgcgctgccgcaggaagacggtcctggtgctcatgtgcattctcacggcctatgtgctgtgctgggcacccttctacggtttcaccatcgttcgtgacttcttccccactgtgttcgtgaaggaaaagcactacctcactgccttctacgtggtcgagtgcatcgccatgagcaacagcatgatcaacaccgtgtgcttcgtgacggtcaagaacaacaccatgaagtacttcaagaagatgatgctgctgcactggcgtccctcccagcgggggagcaagtccagtgctgaccttgacctcagaaccaacggggtgcccaccacagaagaagtggactgtatcaggctgaagtgacccactggtgtcacacaattgaaaaccccagtccagtactcagagcatcacccaccatcaaccaagttcataggctgcatgggaaatgacatctgtgttcatgcctcccccgtgccctcaagaagccgaatgctgcaaagtcgtaacatacaatgagactagacatgaaccaaatcagctgacatttactgatatccgctcgacacctactgtgtccacaatccccacaaggagattagacacaaggagcagcaactgacatggactgaacatgtactgtgtgcaaaccacaccaatgagattagacggggacagcaggagctgacatttactcttcacctactgtaatcaaaaacacttgatttgattacaatcaaaaacatataaaaaacataacaaagtagcagaagctattggagtttccaagctatctccagatatatagatagttcaccctccatcttccctaattctgtatcttaccagtgcaggaatatcaaaaggctataggccaggcatgatggctcatgcctgtaatcccagcacttggggaggctgaggcacgtggatcacttgaggtcaggagttcaacccaggctggccaacatggtgaaaccctgtctctactaaaaatacaaaattagctaggcgtggtggcgggcgcctgtaatcccagttactcaggaggctgaagcaggagaatagcttgaacctgggagttggagtttgcagtgagctgagattgctccactgcactccagcctgagtgacagagtgagactctgtctcaggaaaaaaacaaacaaacaaacaacaaaacaacaacaacaacaacaacaaccaacggctatagaagaagactcttagacacaatggaaatgtaacgataagtttgtcagtgcgtggtttacagcatcatgggaggtgcgttacagccatcatactgaactttcccacccacctcctactgcctcccagggcattctctaggattttggcttcaagaaaaaaaaaattcttatagtcagcccagccttatgtggttatccacaatggtgtaatttcaaaggaaagaacctaaaaatcactttcccactgatgcttgaaagcttatcattttatttgggtggagatgggtaatcctgaggtgtcaatttttgcctcctcagtgcaaaggatttcagtggctctggggtcagggggaaagaggacagagaaaaaagtggaggttgccactggcaatgaacataatctctgtgggcattttgctaaggactggaccactttctagaacactccctcttttacaaaaggaactctacctagaatccaaagacctgggttcaggtcctaactctaagactcaagtcctaaattcatgatgttttctctctgtgtctcagttttgctttaatgaaatggcgatgatgaaaatatctgctcttcataccttgcaagactgttgggagagcccattgaggccatggtttgtgaatgtgcttttcaactgtgcacacgataagaatggagaagtgatattgaacagtttatttggagggagtttatttggaaaccccatccactgtgatttattagagaaatacccacactttttcatccctgttctttggatgaaagactcctgaagacttcacagtgtaccttgtctacagtgggccaaaaagggatccctgttcttggttataatctgggaaatttaacctcagattctcagtgaccccaagactctcagcatccctgcggtcttagaagtgttgacagtcttccctgcatgttgcaaaatagcaccctagtgctgcataaatatcacttctgaatctgtttgtattattatacatttgtggtaactgtaggtacacgtcttcatttcttcttgattcattttgatgtggtagctatgcaaatggtacctggtttgggactgacccatccatatttgaccaattcctaattttttatagacaaggaattaattgtttgcttgtttgattgtttctattatttgttgatttgtttctctgactgaagtttcaaccaatgtttctttctatcaccacccagcagactcaccttcagcccaatcattgtactctcagaaaatgcaggccggcatggtggctcacatctgtaatcccagcacttcgggaggccaagatgggcagatcacctgaggtcaggagttcaagaccagcctggccaacatggcaaaaccccatctctagaaaaatacagaaattagctggcgtggtggcacatgcctgtggtcccagctcctcaggaggctgaggcatgagaattgcttgaaccccagaggcagaggttgcagtgaattgagatcgcaccactgcactccagcctgggtgatagagcaagattccatctcaaaaggaaaataaaagaaaatgcaaacacactataatattagcctaagcaaaactgttaattctgatttacaaaaattcttacttgcttggctttgaaatgcattgtgtaataatgcatttcaaagccaagcaagtaacaattttaggttatgtacatttctataaatataataattgtatttttatttattattctatcctggctcttagccgaatcaggagattctttaggaatggaccatgtaccagtcaagtctgtcagcaggattcatcaccctgttcctttttgtcctagaatataccaacttcctttcattgaaatttaactgaaaaaacttttgtaaatatcagtgtgtatttgtgattttccagtgattaaagtgtgatgttgttatccaattaaataattaacatgtggaatttaaaaaaaaaaaaaaagggcggccgc

SEQ ID NO: 74 - protein, 384 aa, Homo sapiens
MAAQNGNTSFTPNFNPPQDHASSLSFNFSYGDYDLPMDEDEDMTKTRTFFAAKIVIGIALAGIMLVCGIGNFVFIAALTRYKKLRNLTNLLIANLAISDFLVAIICCPFEMDYYVVRQLSWEHGHVLCASVNYLRTVSLYVSTNALLAIAIDRYLAIVHPLKPRMNYQTASFLIALVWMVSILIAIPSAYFATETVLFIVKSQEKIFCGQIWPVDQQLYYKSYFLFIFGVEFVGPVVTMTLCYARISRELWFKAVPGFQTEQIRKRLRCRRKTVLVLMCILTAYVLCWAPFYGFTIVRDFFPTVFVKEKHYLTAFYVVECIAMSNSMINTVCFVTVKNNTMKYFKKMMLLHWRPSQRGSKSSADLDLRTNGVPTTEEVDCIRLK

SEQ ID NO: 75 - DNA, 3433 bp, Homo sapiens
  CDS (74)...(3433)
acagcgctctctcgccccaggtgcccgcgcgcgtggtgagcagctgcaccaggtggcgtccggggtggggtcaatgaagtgcagcctgaggaagatgtggcgccctggagaaaagaaggagccccagggcgttgtctatgaggatgtgccggacgacacggaggatttcaaggaatcgcttaaggtggtttttgaaggaagtgcatatggattacaaaactttaataagcaaaagaaattaaaaacatgtgacgatatggacaccttcttcttgcattatgctgcagcagaaggccaaattgagctaatggagaagatcaccagagattcctctttggaagtgctgcatgaaatggatgattatggaaatacccctctgcattgtgctgtagaaaaaaaccaaattgaaagcgttaagtttcttctcagcagaggagcaaacccaaacctccgaaacttcaacatgatggctcctctccacatagctgtgcagggcatgaataatgaggtgatgaaggtcttgcttgagcatagaactattgatgttaatttggaaggagaaaatggaaacacagctgtgatcattgcgtgcaccacaaataatagcgaagcattgcagattttgcttaacaaaggagctaagccatgtaaatcaaataaatggggatgtttccctattcaccaagctgcattttcaggttccaaagaatgcatggaaataatactaaggtttggtgaagagcatgggtacagtagacagttgcacattaactttatgaataatgggaaagccacccctctccacctggctgtgcaaaatggtgacttggaaatgatcaaaatgtgcctggacaatggtgcacaaatagacccagtggagaagggaaggtgcacagccattcattttgctgccacccagggagccactgagattgttaaactgatgatatcgtcctattctggtagcgtggatattgttaacacaaccgatggatgtcatgagaccatgcttcacagagcttcattgtttgatcaccatgagctagcagactatttaatttcagtgggagcagatattaataagatcgattctgaaggacgctctccacttatattagcaactgcttctgcatcttggaatattgtaaatttgctactctctaaaggtgcccaagtagacataaaagataattttggacgtaattttctgcatttaactgtacagcaaccttatggattaaaaaatctgcgacctgaatttatgcagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccagttatgggcgtatcaatacctgtcagaggctcctacaagacataagtgatacgaggcttctgaatgaaggtgaccttcatggaatgactcctctccatctggcagcaaagaatggacatgataaagtagttcagcttcttctgaaaaaaggtgcattgtttctcagtgaccacaatggctggacagctttgcatcatgcgtccatgggcgggtacactcagaccatgaaggtcattcttgatactaatttgaagtgcacagatcgcttggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttag

SEQ ID NO: 76 - protein, 1119 aa, Homo sapiens
MKCSLRKMWRPGEKKEPQGVVYEDVPDDTEDFKESLKVVFEGSAYGLQNFNKQKKLKTCDDMDTFFLHYAAAEGQIELMEKITRDSSLEVLHEMDDYGNTPLHCAVEKNQIESVKFLLSRGANPNLRNFNMMAPLHIAVQGMNNEVMKVLLEHRTIDVNLEGENGNTAVIIACTTNNSEALQILLNKGAKPCKSNKWGCFPIHQAAFSGSKECMEIILRFGEEHGYSRQLHINFMNNGKATPLHLAVQNGDLEMIKMCLDNGAQIDPVEKGRCTAIHFAATQGATEIVKLMISSYSGSVDIVNTTDGCHETMLHRASLFDHHELADYLISVGADINKIDSEGRSPLILATASASWNIVNLLLSKGAQVDIKDNFGRNFLHLTVQQPYGLKNLRPEFMQMQQIKELVMDEDNDGCTPLHYACRQGGPGSVNNLLGFNVSIHSKSKDKKSPLHFAASYGRINTCQRLLQDISDTRLLNEGDLHGMTPLHLAAKNGHDKVVQLLLKKGALFLSDHNGWTALHHASMGGYTQTMKVILDTNLKCTDRLDEDGNTALHFAAREGHAKAVALLLSHNADIVLNKQQASFLHLALHNKRKEVVLTIIRSKRWDECLKIFSHNSPGNKCPITEMIEYLPECMKVLLDFCMLHSTEDKSCRDYYIEYNFKYLQCPLEFTKKTPTQDVIYEPLTALNAMVQNNRIELLNHPVCKEYLLMKWLAYGFRAHMMNLGSYCLGLIPMTILVVNIKPGMAFNSTGIINETSDHSEILDTTNSYLIKTCMILVFLSSIFGYCKEAGQIFQQKRNYFMDISNVLEWIIYTTGIIFVLPLFVEIPAHLQWQCGAIAVYFYWMNFLLYLQRFENCGIFIVMLEVILKTLLRSTVVFIFLLLAFGLSFYILLNLQDPFSSPLLSIIQTFSMMLGDINYRESFLEPYLRNELAHPVLSFAQLVSFTIFVPIVLMNLLIGLAVGDIAEVQKHASLKRIAMQVELHTSLEKKLPLWFLRKVDQKSTIVYPNKPRSGGMLFHIFCFLFCTGEIRQEIPNADKSLEMEILKQKYRLKDLTFLLEKQHELIKLIIQKMEIISETEDDDSHCSFQDRFKKEQMEQRNSRWNTVLRAVKAKTHHLEP

SEQ ID NO: 77 - DNA, 2042 bp, Homo sapiens
  CDS (421)...(1482)
gcaaggcaagcagcagcccctgtaagcacacgagacaatcccaagtgtcagtgggaaggagatccctttcctgatggggctgcctgtgtccagtccctcccagcttccccagggccctggggctctgcaggcattcagaagtggaagccagccacagcctgggactgaagaggttaatgtgcatctgcctccgaatgttaatgtgtctaggtgatgtcagtgggagccatgaagaagggagtggggagggcagttgggcttggaggcggcagcggctgccaggctacggaggaagacccccttcccgactgcggggcttgcgctccgggacaaggtggcaggcgctggaggctgccgcagcctgcgtgggtggaggggagctcagctcggttgtgggagcaggcgaccggcactggctggatggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccgcctcccagcgcagcatccggctgcggacaaagagggtgacccgcacagccatcgccatctgtctggtcttctttgtgtgctgggcaccctactatgtgctacagctgacccagttgtccatcagccgcccgaccctcacctttgtctacttatacaatgcggccatcagcttgggctatgccaacagctgcctcaacccctttgtgtacatcgtgctctgtgagacgttccgcaaacgcttggtcctgtcggtgaagcctgcagcccaggggcagcttcgcgctgtcagcaacgctcagacggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagcaccttctccctaaaaaaaaaaaaaaaaaaaaaaaaaaaaaaaaaaaaaaaaaaa

SEQ ID NO: 78 - protein, 353 aa, Homo sapiens
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 79 - DNA, 3321 bp, Homo sapiens
  CDS (58)...(2784)
tgctgtgttgcaagaataaactttgggtcttggattgcaataccacctgtggagaaaatggtatgcgagggaaagcgatcagcctcttgcccttgtttcttcctcttgaccgccaagttctactggatcctcacaatgatgcaaagaactcacagccaggagtatgcccattccatacgggtggatggggacattattttggggggtctcttccctgtccacgcaaagggagagagaggggtgccttgtggggagctgaagaaggaaaaggggattcacagactggaggccatgctttatgcaattgaccagattaacaaggaccctgatctcctttccaacatcactctgggtgtccgcatcctcgacacgtgctctagggacacctatgctttggagcagtctctaacattcgtgcaggcattaatagagaaagatgcttcggatgtgaagtgtgctaatggagatccacccattttcaccaagcccgacaagatttctggcgtcataggtgctgcagcaagctccgtgtccatcatggttgctaacattttaagactttttaagatacctcaaatcagctatgcatccacagccccagagctaagtgataacaccaggtatgactttttctctcgagtggttccgcctgactcctaccaagcccaagccatggtggacatcgtgacagcactgggatggaattatgtttcgacactggcttctgaggggaactatggtgagagcggtgtggaggccttcacccagatctcgagggagattggtggtgtttgcattgctcagtcacagaaaatcccacgtgaaccaagacctggagaatttgaaaaaattatcaaacgcctgctagaaacacctaatgctcgagcagtgattatgtttgccaatgaggatgacatcaggaggatattggaagcagcaaaaaaactaaaccaaagtgggcattttctctggattggctcagatagttggggatccaaaatagcacctgtctatcagcaagaggagattgcagaaggggctgtgacaattttgcccaaacgagcatcaattgatggatttgatcgatactttagaagccgaactcttgccaataatcgaagaaatgtgtggtttgcagaattctgggaggagaattttggctgcaagttaggatcacatgggaaaaggaacagtcatataaagaaatgcacagggctggagcgaattgctcgggattcatcttatgaacaggaaggaaaggtccaatttgtaattgatgctgtatattccatggcttacgccctgcacaatatgcacaaagatctctgccctggatacattggcctttgtccacgaatgagtaccattgatgggaaagagctacttggttatattcgggctgtaaattttaatggcagtgctggcactcctgtcacttttaatgaaaacggagatgctcctggacgttatgatatcttccagtatcaaataaccaacaaaagcacagagtacaaagtcatcggccactggaccaatcagcttcatctaaaagtggaagacatgcagtgggctcatagagaacatactcacccggcgtctgtctgcagcctgccgtgtaagccaggggagaggaagaaaacggtgaaaggggtcccttgctgctggcactgtgaacgctgtgaaggttacaactaccaggtggatgagctgtcctgtgaactttgccctctggatcagagacccaacatgaaccgcacaggctgccagcttatccccatcatcaaattggagtggcattctccctgggctgtggtgcctgtgtttgttgcaatattgggaatcatcgccaccacctttgtgatcgtgacctttgtccgctataatgacacacctatcgtgagggcttcaggacgcgaacttagttacgtgctcctaacggggatttttctctgttattcaatcacgtttttaatgattgcagcaccagatacaatcatatgctccttccgacgggtcttcctaggacttggcatgtgtttcagctatgcagcccttctgaccaaaacaaaccgtatccaccgaatatttgagcaggggaagaaatctgtcacagcgcccaagttcattagtccagcatctcagctggtgatcaccttcagcctcatctccgtccagctccttggagtgtttgtctggtttgttgtggatcccccccacatcatcattgactatggagagcagcggacactagatccagagaaggccaggggagtgctcaagtgtgacatttctgatctctcactcatttgttcacttggatacagtatcctcttgatggtcacttgtactgtttatgccaataaaacgagaggtgtcccagagactttcaatgaagccaaacctattggatttaccatgtataccacctgcatcatttggttagctttcatccccatcttttttggtacagcccagtcagcagaaaagatgtacatccagacaacaacacttactgtctccatgagtttaagtgcttcagtatctctgggcatgctctatatgcccaaggtttatattataatttttcatccagaacagaatgttcaaaaacgcaagaggagcttcaaggctgtggtgacagctgccaccatgcaaagcaaactgatccaaaaaggaaatgacagaccaaatggcgaggtgaaaagtgaactctgtgagagtcttgaaaccaacacttcctctaccaagacaacatatatcagttacagcaatcattcaatctgaaacagggaaatggcacaatctgaagagacgtggtatatgatcttaaatgatgaacatgagaccgcaaaaattcactcctggagatctccgtagactacaatcaatcaaatcaatagtcagtcttgtaaggaacaaaaattagccatgagccaaaagtatcaataaacggggagtgaagaaacccgttttatacaataaaaccaatgagtgtcaagctaaagtattgcttattcatgagcagttaaaacaaatcacaaaaggaaaactaatgttagctcgtgaaaaaaatgctgttgaaataaataatgtctgatgttattcttgtatttttctgtgattgtgagaactcccgttcctgtcccacattgtttaacttgtataagacaatgagtctgtttcttgtaatggctgaccagattgaagccctgggttgtgctaaaaataaatgcaatgattgatgcatgcaattttttatacaaataatttatttctaataataaaggaatgttttgcaaaaaaaaaaaaaaaaaactcgag

SEQ ID NO: 80 - protein, 908 aa, Homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYANKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 81 - DNA, 3254 bp, Homo sapiens
  CDS (394)...(1935)
ggggaggaaacgagctggagcagcatctcatctaccctccttgacacctccccgtggctccagcaagccctagaggtcagccttgcggaccaacaggaggactcccagctttcccttttcaagaggtaccccagacaccggccaccctcttccagcccctgcggccagtgcaaggaggcaccaatgctctgaggctgtcgcgtggtgcagcgtcgagcatcctcgccgagtccttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctggcgagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgtaccccagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgtcgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcagggacacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcagaggccacgggaggaagatttgaggaatatgccgtatttaaaagcctgtctgaaagaatctatgaggcttaccccgggtgtaccatttacaactcggactcttgacaaggcaacagttctgggtgaatatgctttacccaaaggaacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttggattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttctaagactagtgattcactggggcattatttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataattcacgtcttgtcatatttcatctgtataccttcaaattctctgaaagtaaaaataaaagtttttaaatatt

SEQ ID NO: 82 - protein, 513 aa, Homo sapiens
MSSPISKSRSLAAFLQQLRSPRQPPRLVTSTAYTSPQPREVPVCPLTAGGETQNAAALPGPTSWPLLASLLQILWKGGLKKQHDTLVEYHKKYGKIFRMKLGSFESVHLGSPCLLEALYRTESVPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQGHTLAWDTIFKSVKACIDNRLEKYSQQPSADFLCDIYHQNRLSKKELYAAVTELQLAAVETTANSLMWILYNLSRNPQVQQKLLKEIQSVLPENQRPREEDLRNMPYLKACLKESMRLTPGVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQR

SEQ ID NO: 83 - DNA, 1662 bp, Homo sapiens
  CDS (1)...(1662)
atgaagctgggatcgagcagggcagggcctgggagaggaagcgcgggactcctgcctggcgtccacgagctgcccatgggcatccctgccccctgggggaccagtcctctctccttccacaggaagtgctctctctgggcccctgggaggcccttcctcactctggtcctgctggtttccatcaagcaagttacaggatccctccttgaggaaacgactcggaagtgggctcagtacaaacaggcatgtctgagagacttactcaaggaaccttctggcatattttgtaacgggacatttgatcagtacgtgtgttggcctcattcttctcctggaaatgtctctgtaccctgcccttcatacttaccttggtggagtgaagagagctcaggaagggcctacagacactgcttggctcaggggacttggcagacgatagagaacgccacggatatttggcaggatgactccgaatgctccgagaaccacagcttcaagcaaaacgtggaccgttatgccttgctgtcaaccttgcagctgatgtacaccgtgggatactccttctctcttatctccctcttcctggctctcaccctcctcttgtttcttcgaaaactccactgcacgcgcaactacatccacatgaacttgtttgcttctttcatcctgagaaccctggctgtactggtgaaggacgtcgtcttctacaactcttactccaagaggcctgacaatgagaatgggtggatgtcctacctgtcagagatgtccacctcctgccgctcagtccaggttctcttgcattactttgtgggtgccaattacttatggctgctggttgaaggcctctacctccacacgctgctggagcccacagtgcttcctgagaggcggctgtggcccagatacctgctgttgggttgggccttccctgtgctatttgttgtaccctggggtttcgcccgtgcacacctggagaacacagggtgctggacaacaaatgggaataagaaaatctggtggatcatccgaggacccatgatgctctgtgtaacagtcaatttcttcatcttcctgaaaattctcaagcttctcatttctaagctcaaagctcatcaaatgtgcttcagagattataaatacagattggcaaaatcaacactggtcctcattcctttattgggcgttcatgagatcctcttctctttcatcactgatgatcaagttgaaggatttgcaaaacttatacgacttttcattcagttgacactgagctcctttcatgggttcctggtggccttgcagtatggttttgccaatggagaagtgaaggctgagctgcggaaatactgggtccgcttcttgctagcccgccactcaggctgcagagcctgtgtcctggggaaggacttccggttcctaggaaaatgtcccaagaagctctcggaaggagatggcgctgagaagcttcggaagctgcagccctcacttaacagtgggcggctcctacatctagccatgcgaggtcttggggagctgggcgcccagccccaacaggaccatgcacgctggccccggggcagcagcctgtccgagtgcagtgagggggatgtcaccatggccaacaccatggaggagattctggaagagagtgagatctag

SEQ ID NO: 84 - protein, 553 aa, Homo sapiens
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 85 - DNA, 2664 bp, Homo sapiens
  CDS (555)...(2144)
gagagaacagcgtgagcctgtgtgcttgtgtgctgagccctcatcccctcctggggccaggcttgggtttcacctgcagaatcgcttgtgctgggctgcctgggctgtcctcagtggcacctgcatgaagccgttctggctgccagagctggacagccccaggaaaacccacctctctgcagagcttgcccagctgtccccgggaagccaaatgcctctcatgtaagtcttctgctcgacggggtgtctcctaaaccctcactcttcagcctctgtttgaccatgaaatgaagtgactgagctctattctgtacctgccactctatttctggggtgacttttgtcagctgcccagaatctccaagccaggctggttctctgcatcctttcaatgacctgttttcttctgtaaccacaggttcggtggtgagaggaagcctcgcagaatccagcagaatcctcacagaatccagcagcagctctgctggggacatggtccatggtgcaacccacagcaaagccctgacctgacctcctgatgctcaggagaagccatgggcccctcctgtcctgtgttcctgtccttcacaaagctcagcctgtggtggctccttctgaccccagcaggtggagaggaagctaagcgcccacctcccagggctcctggagacccactctcctctcccagtcccacggcattgccgcagggaggctcgcataccgagactgaggaccggctcttcaaacacctcttccggggctacaaccgctgggcgcgcccggtgcccaacacttcagacgtggtgattgtgcgctttggactgtccatcgctcagctcatcgatgtggatgagaagaaccaaatgatgaccaccaacgtctggctaaaacaggagtggagcgactacaaactgcgctggaaccccgctgattttggcaacatcacatctctcagggtcccttctgagatgatctggatccccgacattgttctctacaacaatgcagatggggagtttgcagtgacccacatgaccaaggcccacctcttctccacgggcactgtgcactgggtgcccccggccatctacaagagctcctgcagcatcgacgtcaccttcttccccttcgaccagcagaactgcaagatgaagtttggctcctggacttatgacaaggccaagatcgacctggagcagatggagcagactgtggacctgaaggactactgggagagcggcgagtgggccatcgtcaatgccacgggcacctacaacagcaagaagtacgactgctgcgccgagatctaccccgacgtcacctacgccttcgtcatccggcggctgccgctcttctacaccatcaacctcatcatcccctgcctgctcatctcctgcctcactgtgctggtcttctacctgccctccgactgcggcgagaagatcacgctgtgcatttcggtgctgctgtcactcaccgtcttcctgctgctcatcactgagatcatcccgtccacctcgctggtcatcccgctcatcggcgagtacctgctgttcaccatgatcttcgtcaccctgtccatcgtcatcaccgtcttcgtgctcaatgtgcaccaccgctcccccagcacccacaccatgccccactgggtgcggggggcccttctgggctgtgtgccccggtggcttctgatgaaccggcccccaccacccgtggagctctgccaccccctacgcctgaagctcagcccctcttatcactggctggagagcaacgtggatgccgaggagagggaggtggtggtggaggaggaggacagatgggcatgtgcaggtcatgtggccccctctgtgggcaccctctgcagccacggccacctgcactctggggcctcaggtcccaaggctgaggctctgctgcaggagggtgagctgctgctatcaccccacatgcagaaggcactggaaggtgtgcactacattgccgaccacctgcggtctgaggatgctgactcttcggtgaaggaggactggaagtatgttgccatggtcatcgacaggatcttcctctggctgtttatcatcgtctgcttcctggggaccatcggcctctttctgcctccgttcctagctggaatgatctgactgcacctccctcgagctggctcccagggcaaaggggagggttcttggatgtggaagggctttgaacaatgtttagatttggagatgagcccaaagtgccagggagaacagccaggtgaggtgggaggttggagagccaggtgaggtctctctaagtcaggctggggttgaagtttggagtctgtccgagtttgcagggtgctgagctgtatggtccagcaggggagtaataagggctcttccggaaggggaggaagcgggaggcaggcctgcacctgatgtggaggtacaggcagatcttccctaccggggagggatggatggttggatacaggtggctgggctattccatccatctggaagcacatttgagcctccaggcttctccttgacgtcattcctctccttccttgctgcaaaatggctctgcaccagccggcccccaggaggtctggcagagctgagagccatggcctgcaggggctccatatgtccctacgcgtgcagcaggcaaacaaga

SEQ ID NO: 86 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPADFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 87 - DNA, 4452 bp, Homo sapiens
  CDS (36)...(2045)
cgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggtcttttggtgggccttgtgcttcggtatggcattcatgttccgagtgatgtaaataatgtgaccctgagctgtgaagtgcagtcaagtccaactaccttactggttacttttgatccagaagtatttttcaacatattacttcctcctatcatattttatgcaggttatagcctgaaaaggagacatttttttcgaaatcttgggtctatcctagcatacgcttttcttggaacagcaatttcttgtttcgttattgggtcaataatgtatggctgtgtaacgctgatgaaggtaacgggacaacttgcaggagatttttactttacagattgcctactgtttggtgccattgtatcagcaactgatccagtgactgttcttgctatattccacgagcttcaagttgatgttgaactctatgcacttctttttggtgaaagtgtcctcaatgatgctgttgccatagtgctgtcctcctcaatagtggcataccagccagctggagacaacagtcacacctttgatgtcacagcgatgttcaagtctattgggatcttccttggaatcttcagtggatcttttgcaatgggtgctgctactggagtggtgacagctttagtgacaaagttcaccaaattacgggagttccagttgttggagacaggcctgttcttcttgatgtcctggagtaccttcctcttggctgaagcatggggcttcacaggtgtagttgcagtattgttttgtggcatcacacaagcacattatacgtataataatttgtccacggagtctcagcatagaactaaacagttgtttgagcttctcaatttcttggcagagaatttcatcttctcctacatggggctgacactgttcaccttccagaaccatgtctttaacccaacatttgtagtaggagcatttgttgctattttcttgggaagagctgccaatatttaccccttgtccctcttacttaatttgggtagaagaagtaagattggatcaaattttcaacacatgatgatgtttgctggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcagggttggtgttgattcagaccaagaacacttgggtgttcctgaaaatgaaaggagaactaccaaagcagagagtgcttggcttttccggatgtggtacaactttgatcataactatctgaagcctctgctgacccacagcgggcctccgctgacaacaacactccctgcctgctgtggacccatcgccaggtgcctcaccagcccccaggcttacgaaaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtggggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcattttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttataaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactc

SEQ ID NO: 88 - protein, 669 aa, Homo sapiens
MARRGWRRAPLRRGVGSSPRARRLMRPLWLLLAVGVFDWAGASDGGGGEARAMDEEIVSEKQAEESHRQDSANLLIFILLLTLTILTIWLFKHRRARFLHETGLAMIYGLLVGLVLRYGIHVPSDVNNVTLSCEVQSSPTTLLVTFDPEVFFNILLPPIIFYAGYSLKRRHFFRNLGSILAYAFLGTAISCFVIGSIMYGCVTLMKVTGQLAGDFYFTDCLLFGAIVSATDPVTVLAIFHELQVDVELYALLFGESVLNDAVAIVLSSSIVAYQPAGDNSHTFDVTAMFKSIGIFLGIFSGSFAMGAATGVVTALVTKFTKLREFQLLETGLFFLMSWSTFLLAEAWGFTGVVAVLFCGITQAHYTYNNLSTESQHRTKQLFELLNFLAENFIFSYMGLTLFTFQNHVFNPTFVVGAFVAIFLGRAANIYPLSLLLNLGRRSKIGSNFQHMMMFAGLRGAMAFALAIRDTATYARQMMFSTTLLIVFFTVWVFGGGTTAMLSCLHIRVGVDSDQEHLGVPENERRTTKAESAWLFRMWYNFDHNYLKPLLTHSGPPLTTTLPACCGPIARCLTSPQAYENQEQLKDDDSDLILNDGDISLTYGDSTVNTEPATSSAPRRFMGNSSEDALDRELAFGDHELVIRGTRLVLPMDDSEPPLNLLDNTRHGPA

SEQ ID NO: 89 - DNA, 3116 bp, Homo sapiens
  CDS (205)...(2493)
ggcacgagggccagctgctgtagaagaggggaggaaacaagccagtgcaaggggagcaaaagagaaaaggagccaggctgggcttcctgatcccacagcatcgcagagctcgggaggcacagctcacagacacaggaaacacaggactgctattctgctctcctgcccacggtgatctggtgccagctggtggaacagtgggtgatggcgtccctgctgcaagaccagctgaccactgatcaggacttgctgctgatgcaggaaggcatgccgatgcgcaaggtgaggtccaaaagctggaagaagctaagatacttcagacttcagaatgacggcatgacagtctggcatgcacggcaggccaggggcagtgccaagcccagcttctcaatctctgatgtggagacaatacgtaatggccatgattccgagttgctgcgtagcctggcagaggagctccccctggagcagggcttcaccattgtcttccatggccgccgctccaacctggacctgatggccaacagtgttgaggaggcccagatatggatgcgagggctccagctgttggtggatcttgtcaccagcatggaccatcaggagcgcctggaccaatggctgagcgattggtttcaacgtggagacaaaaatcaggatggtaagatgagtttccaagaagttcagcggttattgcacctaatgaatgtggaaatggaccaagaatatgccttcagtctttttcaggcagcagacacgtcccagtctggaaccctggaaggagaagaattcgtacagttctataaggcattgactaaacgtgctgaggtgcaggaactgtttgaaagtttttcagctgatgggcagaagctgactctgctggaatttttggatttcctccaagaggagcagaaggagagagactgcacctctgagcttgctctggaactcattgaccgctatgaaccttcagacagtggcaaactgcggcatgtgctgagtatggatggcttcctcagctacctctgctctaaggatggagacatcttcaacccagcctgcctccccatctatcaggatatgactcaacccctgaaccactacttcatctgctcttctcataacacctacctagtgggggaccagctttgcggccagagcagcgtcgagggatatatacgggccctgaagcgggggtgccgctgcgtggaggtggatgtatgggatggacctagcggggaacctgtcgtttaccacggacacaccctgacctcccgcatcctgttcaaagatgtcgtggccacagtagcacagtatgccttccagacatcagactacccagtcatcttgtccctggagacccactgcagctgggagcagcagcagaccatggcccgtcatctgactgagatcctgggggagcagctgctgagcaccaccttggatggggtgctgcccactcagctgccctcgcctgaggagcttcggaggaagatcctggtgaaggggaagaagttaacacttgaggaagacctggaatatgaggaagaggaagcagaacctgagttggaagagtcagaattggcgctggagtcccagtttgagactgagcctgagccccaggagcagaaccttcagaataaggacaaaaagaagaaatccaagcccatcttgtgtccagccctctcttccctggttatctacttgaagtctgtctcattccgcagcttcacacattcaaaggagcactaccacttctacgagatatcatctttctctgaaaccaaggccaagcgcctcatcaaggaggctggcaatgagtttgtgcagcacaatacttggcagttaagccgtgtgtatcccagcggcctgaggacagactcttccaactacaacccccaggaactctggaatgcaggctgccagatggtggccatgaatatgcagactgcagggcttgaaatggacatctgtgatgggcatttccgccagaatggcggctgtggctatgtgctgaagccagacttcctgcgtgatatccagagttctttccaccctgagaagcccatcagccctttcaaagcccagactctcttaatccaggtgatcagcggtcagcaactccccaaagtggacaagaccaaagaggggtccattgtggatccactggtgaaagtgcagatctttggcgttcgtctagacacagcacggcaggagaccaactatgtggagaacaatggttttaatccatactgggggcagacactatgtttccgggtgctggtgcctgaacttgccatgctgcgttttgtggtaatggattatgactggaaatcccgaaatgactttattggtcagtacaccctgccttggacctgcatgcaacaaggttaccgccacattcacctgctgtccaaagatggcatcagcctccgcccagcttccatctttgtgtatatctgcatccaggaaggcctggagggggatgagtcctgaggtgggcatttcacgggaagggttggtatgctggctttagacggggagaaacatctggaaggatgctcgagagaacaaatggaggtggtgaaaatcaagctttggattgtgcattcctaggcacaaaattacctcattcttcctaacaagcaatctgggacctgattttccaccttttttctcttttcttcccttcctttgttttcataagcctttggtatctttcctgcccttttcctttgtgtactctatactggagttcccttcttcctcttgctgtaggctcaatcccataccgacatctacaactaatctttcccatcaactctgtgtgaaggcaggttgcaactagaaattcagaggggcttggaatagagaaacctaaagaagcatcatcccctccatccccaacttcctcaaagcccaaagccaagggaaggataaatcaaggctcaaggcttccccagcaaagattagggaaagagacttgaccccaggactgtactacgactcttaagagaacactgcacagcactcaaagtcccccactggactgcttcctccttagccccactggtataaatacatctctctccaatttggcaaaaaaaaaaaaaaaaaaa

SEQ ID NO: 90 - protein, 762 aa, Homo sapiens
MASLLQDQLTTDQDLLLMQEGMPMRKVRSKSWKKLRYFRLQNDGMTVWHARQARGSAKPSFSISDVETIRNGHDSELLRSLAEELPLEQGFTIVFHGRRSNLDLMANSVEEAQIWMRGLQLLVDLVTSMDHQERLDQWLSDWFQRGDKNQDGKMSFQEVQRLLHLMNVEMDQEYAFSLFQAADTSQSGTLEGEEFVQFYKALTKRAEVQELFESFSADGQKLTLLEFLDFLQEEQKERDCTSELALELIDRYEPSDSGKLRHVLSMDGFLSYLCSKDGDIFNPACLPIYQDMTQPLNHYFICSSHNTYLVGDQLCGQSSVEGYIRALKRGCRCVEVDVWDGPSGEPVVYHGHTLTSRILFKDVVATVAQYAFQTSDYPVILSLETHCSWEQQQTMARHLTEILGEQLLSTTLDGVLPTQLPSPEELRRKILVKGKKLTLEEDLEYEEEEAEPELEESELALESQFETEPEPQEQNLQNKDKKKKSKPILCPALSSLVIYLKSVSFRSFTHSKEHYHFYEISSFSETKAKRLIKEAGNEFVQHNTWQLSRVYPSGLRTDSSNYNPQELWNAGCQMVAMNMQTAGLEMDICDGHFRQNGGCGYVLKPDFLRDIQSSFHPEKPISPFKAQTLLIQVISGQQLPKVDKTKEGSIVDPLVKVQIFGVRLDTARQETNYVENNGFNPYWGQTLCFRVLVPELAMLRFVVMDYDWKSRNDFIGQYTLPWTCMQQGYRHIHLLSKDGISLRPASIFVYICIQEGLEGDES

SEQ ID NO: 91 - DNA, 1943 bp, Homo sapiens
  CDS (466)...(1758)
gggggctctctccacgccttgctgccgcgtcccggtcctaggcgcccgggatccacggcccaccccgcccgcagcccgcggcctgtctggagaggagtatgaggcccggggccccgcggacgccggccaccgggcggcaggggcctagctgcggagccccgcgcccgagagcggcgggtaaggagccgcgggagccggcgaggcgtcggggcgcgcagaggagcgcccctgcccgggcacccgctgggccacgggactcgcgtgtggcctgagcgccggggaggaggcggaggcgcccctctgtccgggctctgggaaggcaacgaggggctctgcgaaggcggcgaggggctccgcggcggccccggacccctggccaccatcctcacgctcctgctcccgccggggggatgtcgtggcccgggccccgagcgccgccccggccccggggctgagctccggaccatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggcgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaatttttttaaagaaaaaaaaaaaaaaaagggcggatgttatcaagggcaggttttggggacgcc

SEQ ID NO: 92 - protein, 430 aa, Homo sapiens
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 93 - DNA, 2384 bp, Homo sapiens
  CDS (233)...(2260)
gctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagttttgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccaaaaaaaaaaaaaaaaaaaaaaaaaaaaaaaaaaa

SEQ ID NO: 94 - protein, 675 aa, Homo sapiens
MESGTSSPQPPQLDPLDAFPQKGLEPGDIAVLVLYFLFVLAVGLWSTVKTKRDTVKGYFLAGGDMVWWPVGASLFASNVGSGHFIGLAGSGAATGISVSAYELNGLFSVLMLAWIFLPIYIAGQVTTMPEYLRKRFGGIRIPIILAVLYLFIYIFTKISVDMYAGAIFIQQSLHLDLYLAIVGLLAITAVYTVAGGLAAVIYTDALQTLIMLIGALTLMGYSFAAVGGMEGLKEKYFLALASNRSENSSCGLPREDAFHIFRDPLTSDLPWPGVLFGMSIPSLWYWCTDQVIVQRTLAAKNLSHAKGGALMAAYLKVLPLFIMVFPGMVSRILFPDQVACADPEICQKICSNPSGCSDIAYPKLVLELLPTGLRGLMMAVMVAALMSSLTSIFNSASTIFTMDLWNHLRPRASEKELMIVGRVFVLLLVLVSILWIPVVQASQGGQLFIYIQSISSYLQPPVAVVFIMGCFWKRTNEKGAFWGLISGLLLGLVRLVLDFIYVQPRCDQPDERPVLVKSIHYLYFSMILSTVTLITVSTVSWFTEPPSKEMVSHLTWFTRHDPVVQKEQAPPAAPLSLTLSQNGMPEASSSSSVQFEMVQENTSKTHSCDMTPKQSKVVKAILWLCGIQEKGKEELPARAEAIIVSLEENPLVKTLLDVNLIFCVSCAIFIWGYFA

SEQ ID NO: 95 - DNA, 1911 bp, Homo sapiens
  CDS (1)...(1911)
atgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagtgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacaccttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcctttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacatgccttgccgtgacacgggtgtatggcattcagaggttctgccgagacatccacatgatgctgggcttcaagccgggcctctacttcagggcctgctggctgttcctgtccccagccacgctcttggccctcctggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggagtcgatgatgtga

SEQ ID NO: 96 - protein, 636 aa, Homo sapiens
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALLVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 97 - DNA, 2598 bp, Homo sapiens
  CDS (652)...(1923)
aaagctaaatagccatacagcagctctgacaatgttgtgctggatattgcagtttgctttcaaggtgcagatgtaaggatttaaaaaaataataatttggcaccaaataaatatgagtagcattcattgaatctgcggatttcatgacgtctctctgcgtggtccaccacttttctcctaaccggggatttttttttttcttctgccactcttatctttccccacttcattccacccagtctccctcccccgtccctgcccaaacgcgcgcccctccgcccctcccttgggcccagcgcccagccctgctctccgcgctcggccagagggagccagtccggagacggccgcacctggctggagaggctgggcgggcggaggggtggagacccgcggacgccgggaagccggacctggagccggagcagccgcgagcagaatggagtctcctaacagcctctcggtgctgatgtgaaatttgaccatctgattccagtttttttcttttccttttcttttttgcatttccttccctcgccatccgtcgtgtagtgaattgttcagtcttgctccgtttcaagagaggagatcatgattgagtgaagccaccccgtccgcagccaggaaaagcacaaagaagaaactgcaacaatggccaagctgacagaatccatgactaacgtcctggagggcgactccatggatcaggacgtcgaaagcccagtggccattcaccagccaaagttgcctaagcaggccagggatgacctgccaagacacatcagccgagatcggaccaaaaggaaaatccagaggtacgtgaggaaagacggaaagtgcaatgttcatcacggcaacgtgagggagacctatcgctacctgaccgatatcttcaccacattagtggacctgaagtggagattcaacctattgatttttgtcatggtttacacagtgacctggctcttttttggaatgatctggtggttgatcgcatacatacggggagacatggaccacatagaggacccctcctggactccttgtgttaccaacctcaacgggttcgtctctgcttttttattctcaatagagacagaaaccaccattggttatggctaccgggtcatcacagataaatgcccggagggaattattcttctcttaatccaatctgtgttggggtccattgtcaatgcattcatggtgggatgcatgtttgtaaaaatctctcaacccaagaagagggcagagaccctggtcttttccacccatgcagtgatctccatgcgggatgggaaactgtgcctgatgttccgggtaggggaccttaggaattcccacattgtggaggcttccatcagagccaagttgatcaaatccaaacagacctcggagggggagttcatcccgttgaaccagacggatatcaacgtagggtattacacgggggatgaccgtctgtttctggtgtcaccgctgatcattagccatgaaattaaccaacagagtcctttctgggagatctccaaagcccagctgcccaaagaggaactggaaattgtggtcatcctagaaggaatggtggaagccacagggatgacatgccaagctcgaagctcctacatcaccagtgagatcctgtggggttaccggttcacacctgtcctgaccctggaggatgggttctacgaagttgactacaacagcttccatgagacctatgagaccagcaccccatcccttagtgccaaagagctggccgagttagccagcagggcagagctgcccctgagttggtctgtatccagcaaactcaaccaacatgcagaactggagactgaagaggaagaaaagaacctcgaagagcaaacagaaagaaatggtgatgtggcaaacctggagaatgaatccaaagtttagtgccctagctgggcaaacccttctcttctccccccaacacaatctttccttgtctctcattctctttctttttctgtctctcttgctttgttctttatttgtttatatttaatttttacatgaccagaaaacaaatcttcaaggtgtaaaatatctacctgccctctctcagttattcagattgacaaggtagacatggatttgatgaaagtgcaaagtgccctcatttgtggcccaagcctggtctcctcccaaaatactacacatccaactcctggagatttcagttacttacctgcatgtgttgtacaataccagatcactcaaaaaggtgtgtcaaagattttacctgggatatgacaagcaaggtttctggtgcctatttattcattcagtgagacacagagtggagccctcagttttatggatcccaattcatttcatctactacagggtgaggtgcttgcccccatgtgggtgtggcagttacagggcccaggtgagctgaagacaaaccactgtacatatatatgccttatgtaattattttctttttgtaattagtaataaaacccagcatgtacaaaagtaccatagcacagcactgctaaatactgtacatagatgtatcattaatgtaggtttagatatataactttagaaataagaagcaaa

SEQ ID NO: 98 - protein, 423 aa, Homo sapiens
MAKLTESMTNVLEGDSMDQDVESPVAIHQPKLPKQARDDLPRHISRDRTKRKIQRYVRKDGKCNVHHGNVRETYRYLTDIFTTLVDLKWRFNLLIFVMVYTVTWLFFGMIWWLIAYIRGDMDHIEDPSWTPCVTNLNGFVSAFLFSIETETTIGYGYRVITDKCPEGIILLLIQSVLGSIVNAFMVGCMFVKISQPKKRAETLVFSTHAVISMRDGKLCLMFRVGDLRNSHIVEASIRAKLIKSKQTSEGEFIPLNQTDINVGYYTGDDRLFLVSPLIISHEINQQSPFWEISKAQLPKEELEIVVILEGMVEATGMTCQARSSYITSEILWGYRFTPVLTLEDGFYEVDYNSFHETYETSTPSLSAKELAELASRAELPLSWSVSSKLNQHAELETEEEEKNLEEQTERNGDVANLENESKV

SEQ ID NO: 99 - DNA, 3924 bp, Homo sapiens
  CDS (1)...(3168)
atggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccagaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccacccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttccaaaaaaaaaaaaaaaaaaaaaaaaaaaaaaaaaaaaa

SEQ ID NO: 100 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 101 - DNA, 4833 bp, Homo sapiens
  CDS (40)...(4752)
ctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgacttcacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagacgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcgggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtg

SEQ ID NO: 102 - protein, 1570 aa, Homo sapiens
MSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 103 - DNA, 2100 bp, Homo sapiens
  CDS (40)...(1965)
acatcactgcgctggccgtccaaggtccgccgccccaccatgccgcccccgccgctgctgctgctccttacagtcctggtcgtcgccgctgcccggccggggtgcgagtttgagcggaaccccgccgccacctgcgtggacctgcagctcaggacctgcagcgatgccgcctacaaccacaccaccttccccaacctgcttcagcaccggtcgtgggaggtggtggaggccagctccgagtacatcctgctgagcgttctacaccagctcctggaaggccagtgcaacccggacctgcggctgctgggctgtgctgtgctggccccccggtgtgagggcggctgggtgcgcagaccctgccggcacatctgcgagggcctgcgggaggtctgccagcccgccttcgacgccattgacatggcctggccctacttccttgactgccaccgctacttcacgagagaggacgagggctgctatgacccgctggagaagcttcggggaggcctggaggctgacgaggcactgccctcagggctgccgcccaccttcatccgcttcagccaccactcctacgcccagatggtgcgtgtgctgaggcggacggcctcccgctgtgcccacgtggccaggacctacagcatcgggcgcagcttcgacggcagggagctgctggtcatcgagttctccagccgccccggccagcacgagctgatggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccattaaccctgacggctatgaggtggcagctgccgagggtgccggctacaacgggtggacgagcgggaggcagaacgcgcagaacctggatctgaaccgaaatttcccggacctgacgtccgagtactaccggctggcggagacccgcggcgcacgcagcgaccacatccccatcccccagcactactggtggggtaaggtggccccggagacaaaggcaatcatgaagtggatgcagaccataccctttgtgctctcagccagccttcatgggggcgacctggtggtgtcctaccccttcgacttctccaagcacccccaggaggagaagatgttttctcccacgcccgacgagaagatgttcaagctgctgtccagagcctacgctgacgtccaccccatgatgatggacaggtcggagaataggtgtggaggcaatttcctgaagagggggagcatcatcaacggggcggactggtacagcttcacgggaggcatgtccgatttcaactacctgcacaccaactgctttgagatcacggtagagctgggctgtgtgaagttcccccccgaggaggccctgtacacactctggcagcacaacaaggagtcactcctgaatttcgtggagacggtgcaccggggcatcaaaggtgtggtgacagataaattcggcaagccagtcaaaaacgcccggatctcagtcaaaggcattcgccacgacatcaccacagccccagatggtgactactggagactgctgcccccaggtatccacattgtcattgcccaagcccctggctacgccaaagtcatcaagaaagtcatcatccccgcccggatgaagagggctggccgtgtggacttcattctgcaacctctggggatgggacccaagaactttattcatgggctgcggaggactgggccccacgacccgctgggaggtgccagctctttgggggaggccacggagcccgacccgctccgggcgcgcaggcagccctcggccgacgggagtaagccctggtggtggtcctacttcacatcgctgagcacccacaggccacgctggctgctcaagtactagccccggccccagcacccgccaggatgtggagaccgaggcccatctccgcatcccgggctcctggctcttgattttgtctgccacagacatcccacaaagccgctgccattttattaaagtgttttgatccacaaa

SEQ ID NO: 104 - protein, 641 aa, Homo sapiens
MPPPPLLLLLTVLVVAAARPGCEFERNPAATCVDLQLRTCSDAAYNHTTFPNLLQHRSWEVVEASSEYILLSVLHQLLEGQCNPDLRLLGCAVLAPRCEGGWVRRPCRHICEGLREVCQPAFDAIDMAWPYFLDCHRYFTREDEGCYDPLEKLRGGLEADEALPSGLPPTFIRFSHHSYAQMVRVLRRTASRCAHVARTYSIGRSFDGRELLVIEFSSRPGQHELMEPEVKLIGNIHGNEVAGREMLIYLAQYLCSEYLLGNPRIQRLLNTTRIHLLPSINPDGYEVAAAEGAGYNGWTSGRQNAQNLDLNRNFPDLTSEYYRLAETRGARSDHIPIPQHYWWGKVAPETKAIMKWMQTIPFVLSASLHGGDLVVSYPFDFSKHPQEEKMFSPTPDEKMFKLLSRAYADVHPMMMDRSENRCGGNFLKRGSIINGADWYSFTGGMSDFNYLHTNCFEITVELGCVKFPPEEALYTLWQHNKESLLNFVETVHRGIKGVVTDKFGKPVKNARISVKGIRHDITTAPDGDYWRLLPPGIHIVIAQAPGYAKVIKKVIIPARMKRAGRVDFILQPLGMGPKNFIHGLRRTGPHDPLGGASSLGEATEPDPLRARRQPSADGSKPWWWSYFTSLSTHRPRWLLKY

SEQ ID NO: 105 - DNA, 2877 bp, Homo sapiens
  CDS (387)...(1457)
cggccggataggcgcgagggggccgcgtgaggcggtgccggcgttctggcccccaaagccggtctagcgcgccgggcgtcttccttacttccgctgccgccgccgccacatcccgggacccgacgggccgcggcgcggaggcctcggggcaaggtggggcgggcctcccgagctcccaggaccccgcgcgcttcgcccacaggcccggcgaagcccgacccgcgcggcgcccccagggccaggggaggagcctaaggacccggacgagcgccgctccagtaggtgacaagaggaaacaagaacctcagttcaggggaaacacagcaaggaaatgtgagccccaggctgcagaaggaagagtcagtgaatggctgcggtgtgacaacatgcaccaccagtggcttctgctggccgcatgcttttgggtgattttcatgttcatggtggctagcaagttcatcacgttgacctttaaagacccagatgtgtacagtgccaaacaggagtttctgttcctgacaaccatgccggaagtgaggaagttgccagaagagaagcacattcctgaggaactgaagccaactgggaaggagcttccagacagccagctcgttcagcccctggtctacatggagcgcctggaactcatcagaaacgtctgcagggatgatgccctgaagaatctctcgcacactcctgtctccaagtttgtcctggaccgaatatttgtctgtgacaagcacaagattcttttctgccagactcccaaagtgggcaacacccagtggaagaaagtgctgattgttctaaatggagcattttcttccattgaggagatccccgaaaacgtggtgcacgaccacgagaagaacggccttcctcggctctcttccttcagtgatgcagaaattcagaagcgattgaaaacatacttcaagttttttattgtaagagatcccttcgaaagacttatttctgcatttaaggataaatttgttcacaatccccggtttgagccttggtacaggcatgagattgctcctggcatcatcagaaaatacaggaggaaccggacagagacgcgggggatccagtttgaagatttcgtgcgctacctcggcgatccgaaccacagatggctagaccttcagtttggggaccacatcattcactgggtgacgtatgtagagctctgtgctccctgtgagataatgtacagtgtgattggacaccacgagaccctggaggacgatgccccatacatcttaaaagaggctggcattgaccacctggtgtcatacccgactatccctccgggcattaccgtgtataacagaaccaaggtggagcactatttcctgggcatcagcaaacgagacatccgacgcctgtatgcccgtttcgaaggggactttaagctctttgggtaccagaaaccagactttttgctaaactaatgcataagacctatgaattcaaatatctttattagacctggggctaaccaggtgaagatctgagcccagaaatgacccttcctccaccacacccctcctttgaggatgcccggggtctcccacaggcctgtgagttgcctcggcatatgacgcagaaccccaactgttacaacttagtttggatgtaagatgctctgaggaccctgcccacacccctgcgtgcattaggatgtcgctggcctttgctcacctcagaggggagaaaaggctaaagatttgcagtttgacagcccagcagggaggaagcatcacacagcgttaggagccgtttccttcaggtgttaaggaaggggatgcccctgaggttctcctggctagtcggggtggcttcacccatcactggtgggttgcaggaacagcacccaggactctgaggagggacagagaagcaagggggctgctgaaatcgcagagacttttgcagcatcagatctgaggagtaaaacggcacctctggccttcatcttggtgctgcgacaattgtggaggcaaagcattctttctgtgactattttgttcctgtagacagtcagcgatggccagagggtggtgtggtgtccaggggtccatctttccagaatccatgcctgtgtaatgctggtccatgcttctgaacctgtgtctgccaagcgcctatttcattcagcacaagacatacgattttagaaggtgaggggaggggaggctttttctacctgagaaggggagtgtctttgagggccttaaaaggaccatggcccaggaatgggggcgctggttgggcttggagctcaggctgctgtggatcccggcgcatcagttctgacttgccttacctgggtggacagcagtgaatctccacctgtcttctccagggagctcccatgttggggctgaagacgagcaggggcaacctgccagcatcacagaattcagtgtagtttatacatttcgattcctttcatctcagcaaaatgggcactgccagagccatttctgatcacaccaccatcctggaccatgtgactggaaggtgggtaaccaagttcaccagcaataaaacccagcgcccaggtagcctccagcagtgcggcttcctggcaacaaggtaggccctggtgcagggcaagccgcagcgaccatttcagataccgtccacagccaggaccgctgagaactgggacagtttcctgggatgagtgccagcctgagcctgcatggtgccgccgagcccggggtggaggagggagccaggcttcgcttcaaggcggcctctaccttttctcagaatggtttcctgattgtgtcaatgtgaaagttaaataaaatttatgtgccaaaaaaaaaaaaaaaaaaaaaaaaaaaaaaaaaaaaaaaaaaa

SEQ ID NO: 106 - protein, 356 aa, Homo sapiens
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 107 - DNA, 2095 bp, Homo sapiens
  CDS (478)...(1959)
gttggagcggtgcaggttcccaggctccaggtactgggcgccttacgagctgggaggtggtgcctctcacccagctaattgctctctagcccttggccttcacaggtgttggtgcctgccgtgaacgcattctgacctgggccgtatctgtctcccaagactttgtgcctatggttggggacagagtgaggtcgttgccttgacgacgacagcatgcggcccgtggtcctcctaagtgtgagcttgcggcggaccgaggcccacctgcctccctgcctgcttcgccctggactcgtgactgcgtccgcagaagaaatcacaacagcgctggaattgctagtttgctaggcagcatcttttggacctgcgaaccatatgcatttcacctcaaatttgtttccaagttgaaaacctttgggtctttctatgcgaacggattgaagaaacgcaaaaagtttctacggactttaaattaaaatggaaaaatatgaaaacctgggtttggttggagaagggagttatggaatggtgatgaagtgtaggaataaagatactggaagaattgtggccataaagaagttcttagaaagtgacgatgacaaaatggttaaaaagattgcaatgcgagaaatcaagttactaaagcaacttaggcatgaaaacttggtgaatctcttggaagtgtgtaagaaaaaaaaacgatggtacctagtctttgaatttgttgaccacacaattcttgatgacttggagctctttccaaatggactagactaccaagtagttcaaaagtatttgtttcagattattaatggaattggattttgtcacagtcacaatatcatacacagagatataaagccagagaatatattagtctcccagtctggcgttgtcaagctatgcgattttggatttgcgcgaacattggcagctcctggggaggtttatactgattatgtggcaacccgatggtacagagctccagaactattggttggtgatgtcaagtatggcaaggctgttgatgtgtgggccattggttgtctggtaactgaaatgttcatgggggaacccctatttcctggagattctgatattgatcagctatatcatattatgatgtgtttaggtaatctaattccaaggcatcaggagctttttaataaaaatcctgtgtttgctggagtaaggttgcctgaaatcaaggaaagagaacctcttgaaagacgctatcctaagctctctgaagtggtgatagatttagcaaagaaatgcttacatattgaccccgacaaaagacccttctgtgctgagctcctacaccatgatttctttcaaatggatggatttgctgagaggttttcccaagaactacagttaaaagtacagaaagatgccagaaatgtttctttatctaaaaaatcccaaaacagaaagaaggaaaaagaaaaagatgattccttagttgaagaaagaaaaacacttgtggtacaggataccaatgctgatcccaaaattaaggattataaactatttaaaataaaaggctcaaaaattgatggagaaaaagctgaaaaaggcaatagagcttcaaatgccagctgtctccatgacagtaggacaagccacaacaaaatagtgccttcaacaagcctcaaagactgcagcaatgtcagcgtggaccacacaaggaatccaagcgtggcaattcccccacttacacacaatctttctgcagttgctcccagcattaattctggaatggggactgagactataccaattcagggttacagagtggatgagaaaactaagaagtgttctattccatttgttaaaccgaacagacattccccatcaggcatttataacattaatgtgaccacattagtatcaggacctcccctgtcagatgattcaggggctgatttgcctcaaatggaacaccagcactgagaaccattttggttctgaactggatgatgctcttgcacttgagatgacatcttcttgcagcaagaaaaaaaaaaaaaaaaaaaaaaaaaaaacaaaaaaaaaaaaaaaaaaaaaaaaaaaaaaaaaaaaaaaaaaa

SEQ ID NO: 108 - protein, 493 aa, Homo sapiens
MEKYENLGLVGEGSYGMVMKCRNKDTGRIVAIKKFLESDDDKMVKKIAMREIKLLKQLRHENLVNLLEVCKKKKRWYLVFEFVDHTILDDLELFPNGLDYQVVQKYLFQIINGIGFCHSHNIIHRDIKPENILVSQSGVVKLCDFGFARTLAAPGEVYTDYVATRWYRAPELLVGDVKYGKAVDVWAIGCLVTEMFMGEPLFPGDSDIDQLYHIMMCLGNLIPRHQELFNKNPVFAGVRLPEIKEREPLERRYPKLSEVVIDLAKKCLHIDPDKRPFCAELLHHDFFQMDGFAERFSQELQLKVQKDARNVSLSKKSQNRKKEKEKDDSLVEERKTLVVQDTNADPKIKDYKLFKIKGSKIDGEKAEKGNRASNASCLHDSRTSHNKIVPSTSLKDCSNVSVDHTRNPSVAIPPLTHNLSAVAPSINSGMGTETIPIQGYRVDEKTKKCSIPFVKPNRHSPSGIYNINVTTLVSGPPLSDDSGADLPQMEHQH

SEQ ID NO: 109 - DNA, 2419 bp, Homo sapiens
  CDS (21)...(875)
gcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggcgttgcaaaaaaaaaaaaaaaaaaaaaaaaaaaaaaaaaaaaaaaaaaaaaaaa

SEQ ID NO: 110 - protein, 284 aa, Homo sapiens
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 111 - DNA, 3931 bp, Homo sapiens
  CDS (298)...(1446)
ccggctttcttccgtcctgccgtccccgggcccctagcccccagtcccctctcccccctccacctcttgtccctcggcctccgcgcctcccctcccccgactctctggcctcccattcattccgtccgctccctcccatttcctcttttccgctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcgccaacacatatctctttatggtacaagctcgaggtataatgttgagagaaaatgtgaaaacaataggtcatatgatcaggctgtacacaaataaaaacagtacgctcaacggtacagattatcccgaaggcaataattcaagtgattatcttgttcaaacaacaacgtatctcccggaaaacttcacatactcaccatacctcccctgtccagaaaagctgccttatatgcgaggattcctcaatgtcaatgtaagcgaagtcagttttgatgaaattcatcaactcttctccaaggatttagatattgagccagggggtcattggaggccaaaagactgtaaacccagatggaaggtggcagttctcattcctttccgtaatcgccatgaacatcttccaatttttttcttacatctgattccaatgctccagaagcagcggctggaatttgcgttttatgtcattgaacagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatattcttccatataaagaattttttggtggtgtaagtgggctgacagtggaacaatttagaaagatcaatggttttcctaatgccttctggggatggggaggagaagatgatgacctttggaacagagttcactatgctggatataatgtaaccagaccagagggagacttaggaaaatacaagtcaattcctcatcaccatagaggtgaagtccagtttttaggacggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaatgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacatgatgagttatttggtgcactgatgccataatgtcttctatatgtaatatcttacatgtttgcatgagtgtcagggctttgtccagttatcttcatatgactgttctctgagaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaattaaaaaaaaaaaaaaaaaaaaaaaaaaaaaaaaaaaaaaaaaaa

SEQ ID NO: 112 - protein, 382 aa, Homo sapiens
MSVLRRMMRVSNRSLLAFIFFFSLSSSCLYFIYVAPGIANTYLFMVQARGIMLRENVKTIGHMIRLYTNKNSTLNGTDYPEGNNSSDYLVQTTTYLPENFTYSPYLPCPEKLPYMRGFLNVNVSEVSFDEIHQLFSKDLDIEPGGHWRPKDCKPRWKVAVLIPFRNRHEHLPIFFLHLIPMLQKQRLEFAFYVIEQTGTQPFNRAMLFNVGFKEAMKDSVWDCVIFHDVDHLPENDRNYYGCGEMPRHFAAKLDKYMYILPYKEFFGGVSGLTVEQFRKINGFPNAFWGWGGEDDDLWNRVHYAGYNVTRPEGDLGKYKSIPHHHRGEVQFLGRYKLLRYSKERQYIDGLNNLIYRPKILVDRLYTNISVNLMPELAPIEDY

SEQ ID NO: 113 - DNA, 3761 bp, Homo sapiens
  CDS (70)...(2760)
gtggcggacgggcggacgcgggccggcggccgctgcggtgccgggagggcggctgggcaggcggcaggaatgctgcgcgccgccctgtccctgctcgcgctgcccctggcgggggcggccgaagagcccacccagaagccagagtccccgggcgagcctcccccaggcttagagctcttccgctggcagtggcacgaggtggaggcgccctacctggtggccctgtggatcctggtggccagtctggccaaaatcgtgtttcacctgtctcggaaagtaacatctctggtccctgagagctgcctgctgattttgctgggcctggtgctagggggaattgttttggctgtggccaagaaagctgagtaccagctggagccaggcaccttcttcctcttcctgctgcctcctattgtgttggactcaggctatttcatgcctagcaggctgttctttgacaacttgggtgccatcctcacctatgccgtggtaggcacactctggaatgccttcacaacaggcgctgccctctggggcttgcagcaggctggacttgtagcccctagggtgcaggctggcttactggacttcctgctgtttgggagcctcatctcggcggtggaccccgtggccgtgctagctgtctttgaggaggtgcacgtcaatgagactctctttatcatcgtctttggcgagtccctgctcaacgatgctgtcaccgtggtgctgtacaaggtctgcaactcctttgtggagatgggctctgccaatgtgcaggccactgactacctgaagggagtcgcctccctgtttgtggtcagtctgggcggggcagccgtgggcttagtctttgccttcctcctggccctgaccacacgcttcaccaagcgggtccgcatcatcgagccgctgctggtcttcctcctcgcctacgcagcctacctcactgctgaaatggcctcgctctccgccattcttgcggtgaccatgtgtggcctgggctgtaagaagtacgtggaggccaacatctcccataagtcacgcacaactgtcaaatatacaatgaagactctagccagctgtgctgagaccgtgatcttcatgctgcttggcatctcagccgtggactcttctaagtgggcctgggattctgggctggtgctgggcaccctcatcttcatcctgttcttccgagccctcggcgtagtcctgcagacctgggtgctgaatcagttccggctagtccctctggacaagattgaccaagtggtgatgtcctatgggggcctgcggggggctgtggcctttgctctcgtcatcctactggataggaccaaggtccctgccaaggactactttgtagccaccactattgtagtggtcttcttcacagtcatcgtgcagggcttgaccatcaagccactggtcaaatggctgaaggtgaagaggagtgagcatcacaaacccaccctgaaccaggagctgcatgaacacacttttgaccacattctggctgcagtggaggacgttgtggggcaccatggctaccactactggagggacaggtgggagcagtttgacaagaaatacctgagtcagctgctgatgcgacgatcagcctaccgcatccgggaccagatctgggatgtgtactacaggcttaacatccgggatgccatcagctttgtggaccagggaggccacgtcttgtcttccacaggtctcactctgccttctatgcccagccgcaattctgtggcagaaacttctgtcaccaacctgctgagggagagtggcagtggagcgtgtctggatctgcaggtgattgacacagtacgcagcggccgggatcgtgaggatgctgtgatgcatcatctgctctgcggaggcctctacaagccgcgccgtaggtacaaagccagctgcagtcgccacttcatctcagaggatgcgcaggagcggcaggacaaggaggtcttccagcagaacatgaagcggcggctggagtcctttaagtccaccaagcacaacatctgcttcaccaagagcaagccacgaccccgcaagactggccgcaggaagaaggatggtgtggcgaatgctgaggctacaaatgggaaacatcgaggcctgggctttcaggacacagctgctgtgatattaaccgtggagtctgaggaggaggaggaggagagcgacagttcagagacagagaaggaggacgatgaggggatcatctttgtggctcgtgccaccagtgaggttctccaagagggcaaggtctcaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagcttccctgccccaatcctccccagcatggtcatgttcgtggtgtcctggcagtgaagctccgtgagggggctggcccttagaggaactggggtgggaagtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctaaacctttctgatccttgggtctgggttttttgaggaagggacatagtggcctctgggctgccatgtcaccacctgcaacattccccaaacagataagaacccatcatctcagggccactgctccattgctctgggggctgggattcctggctaagcaggggctgacagggtggcaggtgactttctagggatcagcacctgccctgtgttttgtaccttgaacctaagatatattaaacatctctcagatggaaaaaaaaaaaaaaaaaaaa

SEQ ID NO: 114 - protein, 896 aa, Homo sapiens
MLRAALSLLALPLAGAAEEPTQKPESPGEPPPGLELFRWQWHEVEAPYLVALWILVASLAKIVFHLSRKVTSLVPESCLLILLGLVLGGIVLAVAKKAEYQLEPGTFFLFLLPPIVLDSGYFMPSRLFFDNLGAILTYAVVGTLWNAFTTGAALWGLQQAGLVAPRVQAGLLDFLLFGSLISAVDPVAVLAVFEEVHVNETLFIIVFGESLLNDAVTVVLYKVCNSFVEMGSANVQATDYLKGVASLFVVSLGGAAVGLVFAFLLALTTRFTKRVRIIEPLLVFLLAYAAYLTAEMASLSAILAVTMCGLGCKKYVEANISHKSRTTVKYTMKTLASCAETVIFMLLGISAVDSSKWAWDSGLVLGTLIFILFFRALGVVLQTWVLNQFRLVPLDKIDQVVMSYGGLRGAVAFALVILLDRTKVPAKDYFVATTIVVVFFTVIVQGLTIKPLVKWLKVKRSEHHKPTLNQELHEHTFDHILAAVEDVVGHHGYHYWRDRWEQFDKKYLSQLLMRRSAYRIRDQIWDVYYRLNIRDAISFVDQGGHVLSSTGLTLPSMPSRNSVAETSVTNLLRESGSGACLDLQVIDTVRSGRDREDAVMHHLLCGGLYKPRRRYKASCSRHFISEDAQERQDKEVFQQNMKRRLESFKSTKHNICFTKSKPRPRKTGRRKKDGVANAEATNGKHRGLGFQDTAAVILTVESEEEEEESDSSETEKEDDEGIIFVARATSEVLQEGKVSGSLEVCPSPRIIPPSPTCAEKELPWKSGQGDLAVYVSSETTKIVPVDMQTGWNQSISSLESLASPPCNQAPILTCLPPHPRGTEEPQVPLHLPSDPRSSFAFPPSLAKAGRSRSESSADLPQQQELQPLMGHKDHTHLSPGTATSHWCIQFNRGSRL

SEQ ID NO: 115 - DNA, 1968 bp, Homo sapiens
  CDS (73)...(1176)
cgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcgtggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctcttatctccctccaacaaaccctggctccagccccctttcccaacttgagttgcatcatcttggaaccaggaagcccagctaaagccaagagaccagagagtctctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgacgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaaaaaaaaaaaaaaaaaa

SEQ ID NO: 116 - protein, 367 aa, Homo sapiens
MAYRVLGRAGPPQPRRARRLLFAFTLSLSCTYLCYSFLCCCDDLGRSRLLGAPRCLRGPSAGGQKLLQKSRPCDPSGPTPSEPSAPSAPAAAVPAPRLSGSNHSGSPKLGTKRLPQALIVGVKKGGTRAVLEFIRVHPDVRALGTEPHFFDRNYGRGLDWYRSLMPRTLESQITLEKTPSYFVTQEAPRRIFNMSRDTKLIVVVRNPVTRAISDYTQTLSKKPDIPTFEGLSFRNRTLGLVDVSWNAIRIGMYVLHLESWLQYFPLAQIHFVSGERLITDPAGEMGRVQDFLGIKRFITDKHFYFNKTKGFPCLKKTESSLLPRCLGKSKGRTHVQIDPEVIDQLREFYRPYNIKFYETVGQDFRWE

SEQ ID NO: 117 - DNA, 2104 bp, Homo sapiens
  CDS (96)...(1616)
tcaacggattcttctcgctcgctgcccggaaagaaccatttgggagagcccatggtgactgcgtgagtggagcccagctgtgtggatgccccagcatggatgactacatggtcctgagaatgattggggagggctccttcggcagagctcttttggttcagcatgaaagcagtaatcagatgtttgccatgaaagaaataaggcttcccaagtctttctctaatacacagaattctaggaaggaggctgttcttttagccaaaatgaaacaccctaatattgttgccttcaaagaatcatttgaagctgaaggacacttgtatattgtgatggaatactgtgatggaggggatctaatgcaaaagattaaacagcagaaaggaaagttatttcctgaagacatgatacttaattggtttacccaaatgtgccttggagtaaatcacattcacaagaaacgtgtgctacacagagatatcaagtccaagaatatcttcctcactcagaatggaaaagtgaaattgggagactttggatctgcccgtcttctctccaatccgatggcatttgcttgtacctatgtgggaactccttattatgtgcctccagaaatttgggaaaacctgccttataacaataaaagtgacatctggtccttgggttgcatcctgtatgaactctgtacccttaagcatccatttcaggcaaatagttggaaaaatcttatcctcaaagtatgtcaagggtgcatcagtccactgccgtctcattactcctatgaacttcagttcctagtcaagcagatgtttaaaaggaatccctcacatcgcccctcggctacaacgcttctctctcgaggcatcgtagctcggcttgtccagaagtgcttaccccccgagatcatcatggaatatggtgaggaagtattagaagaaataaaaaattcgaagcataacacaccaagaaaaaaaacaaaccccagcagaatcaggatagctttgggaaatgaagcaagcacagtgcaagaggaagaacaagatagaaagggtagccatactgatttggaaagcattaatgaaaatttagttgaaagtgcattgagaagagtaaacagagaagaaaaaggtaataagtcagtccatctgaggaaagccagttcaccaaatcttcatagacgacagtgggagaaaaatgtacccaatacagctcttacagctttggaaaatgcatccatactcacctccagtttaacagcagaggacgatagaggtggttctgtaataaagtacagcaaaaatactactcgtaagcagtggctcaaagagacccctgacactttgttgaacatccttaagaatgctgatctcagcttggcttttcaaacatacacaatatatagaccaggttcagaagggttcttgaaaggccccctgtctgaagaaacagaagcatcggacagtgttgatggaggtcacgattctgtcattttggatccagagcgacttgagcctgggctagatgaggaggacacggactttgaggaggaagatgacaaccccgactgggtgtcagagctgaagaagcgagctggatggcaaggcctgtgcgacagataatgcctgaggaaatgttcctgagtcacgctgaggagagccttcactcaggagttcatgctgagatgatcatgagttcatgcgacgtatattttcctttggaaacagaatgaagcagaggaaactcttaatacttaaaatcgttcttgattagtatcgtgagtttgaaaagtctagaactcctgtaagtttttgaactcaagggagaaggtatagtggaatgagtgtgagcatcgggctttgcagtcccatagaacagaaatgggatgctagcgtgccactacctacttgtgtgattgtgggaaattacttaacctcttcaagccccaatttcctcaaccataaaatgaagataataatgcctacctcagagggatgctgaccacagacctttatagcagcccgtatgatattattcacattatgatatgtgtttattattatgtgactctttttacatttcctaaaggtttgagaattaaatcccgccc

SEQ ID NO: 118 - protein, 506 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 119 - DNA, 2110 bp, Homo sapiens
  CDS (1)...(1236)
atggacgcggcactgctccacagcctgctggaggccaactgcagcctggcgctggctgaagagctgctcttggacggctgggggccacccctggaccccgagggtccctactcctactgcaacacgaccttggaccagatcggaacgtgctggccccgcagcgctgccggagccctcgtggagaggccgtgccccgagtacttcaacggcgtcaagtacaacacgacccggaatgcctatcgagaatgcttggagaatgggacgtgggcctcaaagatcaactactcacagtgtgagcccattttggatgacaagcagaggaagtatgacctgcactaccgcatcgcccttgtcgtcaactacctgggccactgcgtatctgtggcagccctggtggccgccttcctgcttttcctggccctgcggagcattcgctgtctgcggaatgtgattcactggaacctcatcaccacctttatcctgcgaaatgtcatgtggttcctgctgcagctcgttgaccatgaagtgcacgagagcaatgaggtctggtgccactgcatcaccaccatcttcaactacttcgtggtgaccaacttcttctggatgtttgtggaaggctgctacctgcacacggccattgtcatgacctactccactgagcgcctgcgcaagtgcctcttcctcttcatcggatggtgcatccccttccccatcatcgtcgcctgggccatcggcaagctctactatgagaatgaacagtgctggtttggcaaggagcctggcgacctggtggactacatctaccaaggccccatcattctcgtgctcctgatcaatttcgtatttctgttcaacatcgtcaggatcctaatgacaaagttacgcgcgtccaccacatccgagacaatccagtacaggaaggcagtgaaggccaccctggtgctcctgcccctcctgggcatcacctacatgctcttcttcgtcaatcccggggaggacgacctgtcacagatcatgttcatctatttcaactccttcctgcagtcgttccagggtttcttcgtgtctgtcttctactgcttcttcaatggagaggtgcgctcagccgtgaggaagaggtggcaccgctggcaggaccatcactcccttcgagtccccatggcccgggccatgtccatccctacatcacccacacggatcagcttccacagcatcaagcagacggccgctgtgtgacccctcggtcgcccacctgcacagctcccctgtcctcctccaccttcttcctctgggttctctgtgctgggcaggctctcgtggggcaggagatgggaggggagagaccagctctccagcctggcaggaaagagggggtgcggcagccaagggggactgcaagggacagggatgagtgggggccaccaggctcagcgcaagaggaagcagagggaattcacaggaccccctgagaagagccagtcagatgtctgcaggcatttgcccatcccagcctctctggccagggccttactgggcccagagcagagaaggacctgtccaacacacacagctatttatagtagcagacacagggctcccctgccctactcatggagccagcagccaggcaatggtgtggccctgcactggcccttggactccacactcagtggtgccctgcagttgggtgggttaacgccaagcaaaggatcagtttggctgccttatcccagggctgtcacctagagaggctcacttgtaccccaccctgttcctgtgtcccctccccagccatcctccccgccttgggggctccatgaaggatgcaggcttccaggcctggcttcctctcttgggagaccccttctctgcctagtccacagattaggcaatcaaggaagacgccatcagggaagccacatccttagtcaaccagttgcatcgtgcggggcaaaatgaggagcagaggcatggaggagggaggcgtgggatgggaatagcagaaccaccatgtcttcagtgattgaaactcataccccattgccctttgccctccagtctccccttcagaaacatctctgctctctgtgaaataaaccatgcctcttgg

SEQ ID NO: 120 - protein, 411 aa, Homo sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCHCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 121 - DNA, 1663 bp, Homo sapiens
  CDS (128)...(1663)
tctggcgcgatgcttaccttgcgttctctcccctgaacgtcaaggtttaagcagagcccgaggactgggagctcttctctgaaattcgatcaacctgaagccagttgcggaactgcacggggtcccgatggacctcaaggaaagccccagtgagggcagcctgcaaccttctagcatccagatctttgccaacacctccaccctccatggcatccgccacatcttcgtgtatgggccgctgaccatccggcgtgtgctgtgggcagtggccttcgtgggctctctgggcctgctgctggtggagagctctgagagggtgtcctactacttctcctaccagcatgtcactaaggtggacgaagtggtggctcaaagcctggtcttcccagctgtgaccctctgtaacctcaatggcttccggttctccaggctcaccaccaacgacctgtaccatgctggggagctgctggccctgctggatgtcaacctgcagatcccggacccccatctggctgacccctccgtgctggaggccctgcggcagaaggccaacttcaagcactacaaacccaagcagttcagcatgctggagttcctgcaccgtgtgggccatgacctgaaggatatgatgctctactgcaagttcaaagggcaggagtgcggccaccaagacttcaccacagtgtttacaaaatatgggaagtgttacatgtttaactcaggcgaggatggcaaacctctgctcaccacggtcaagggggggacaggcaacgggctggagatcatgctggacattcagcaggatgagtacctgcccatctggggagagacagaggaaacgacatttgaagcaggagtgaaagttcagatccacagtcagtctgagccacctttcatccaagagctgggctttggggtggctccagggttccagacctttgtggccacacaggagcagaggctcacatacctgcccccaccgtggggtgagtgccgatcctcagagatgggcctcgacttttttcctgtttacagcatcaccgcctgtaggattgactgtgagacccgctacattgtggaaaactgcaactgccgcatggttcacatgccaggggatgcccctttttgtacccctgagcagcacaaggagtgtgcagagcctgccctaggtctgttggcggaaaaggacagcaattactgtctctgcaggacaccctgcaacctaacccgctacaacaaagagctctccatggtgaagatccccagcaagacatcagccaagtaccttgagaagaaatttaacaaatcagaaaaatatatctcagagaacatccttgttctggatatattttttgaagctctcaattatgagacaattgaacagaagaaggcgtatgaagttgctgccttacttggtgatattggtggtcagatgggattgttcattggtgctagtatccttacaatactagagctctttgattatatttatgagctgatcaaagagaagctattagacctgcttggcaaagaggaggatgaagggagccacgatgagaatgtgagtacttgtgacacaatgccaaaccactctgaaaccatcagtcacactgtgaacgtgcccctgcagacgaccctggggaccctggaagaaatagcctgc

SEQ ID NO: 122 - protein, 512 aa, Homo sapiens
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRFSRLTTNDLYHAGELLALLDVNLQIPDPHLADPSVLEALRQKANFKHYKPKQFSMLEFLHRVGHDLKDMMLYCKFKGQECGHQDFTTVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 123 - DNA, 3645 bp, Homo sapiens
  CDS (1)...(3645)
atggagaagtatgttagactacagaagattggagaaggttcatttggaaaagccattcttgttaaatctacagaagatggcagacagtatgttatcaaggaaattaacatctcaagaatgtccagtaaagaaagagaagaatcaaggagagaagttgcagtattggcaaacatgaagcatccaaatattgtccagtatagagaatcatttgaagaaaatggctctctctacatagtaatggattactgtgagggaggggatctgtttaagcgaataaatgctcagaaaggcgttttgtttcaagaggatcagattttggactggtttgtacagatatgtttggccctgaaacatgtacatgatagaaaaattcttcatcgagacattaaatctcagaacatatttttaactaaagatggaacagtacaacttggagattttggaattgctagagttcttaatagtactgtagagctggctcgaacttgcatagggaccccatactacttgtcacctgaaatctgtgaaaacaaaccttacaataataaaagtgacatttgggctctggggtgtgtcctttatgagctgtgtacacttaaacatgcttttgaagctggcagtatgaaaaacctggtactgaagataatatctggatcttttccacctgtgtctttgcattattcctatgatctccgcagtttggtgtctcagttatttaaaagaaatcctagggatagaccatcagtcaactccatattggagaaaggttttatagccaaacgcattgaaaagtttctctctcctcagcttattgcagaagaattttgtctaaaaacattttcgaagtttggatcacagcctataccagctaaaagaccagcttcaggacaaaactcgatttctgttatgcctgctcagaaaattacaaagcctgccgctaaatatggaatacctttagcatataagaaatatggagataaaaaattacacgaaaagaaaccactgcaaaaacataaacaggcccatcaaactccagagaagagagtgaatactggagaagaaaggaggaaaatatctgaggaagcagcaagaaagagaaggctggaatttattgaaaaagaaaagaaacaaaaggatcagattattagtttaatgaaggctgaacaaatgaaaaggcaagaaaaggaaaggttggaaagaataaatagggccagggaacaaggatggagaaatgtgctaagtgctggtggaagtggtgaagtaaaggctccttttctgggcagtggagggactatagctccatcatctttttcttctcgaggacagtatgaacattaccatgccatttttgaccaaatgcagcaacaaagagcagaagataatgaagctaaatggaaaagagaaatatatggtcgaggtcttccagaaaggcaaaaagggcagctagctgtagaaagagctaaacaagtagaagagttcctgcagcgaaaacgggaagctatgcagaataaagctcgagccgaaggacatatggtttatctggcaagactgaggcaaataagactacagaatttcaatgagcgccaacagattaaagccaaacttcgtggtgaaaagaaagaagctaatcattctgaaggacaagaaggaagtgaagaggctgacatgaggcgcaaaaaaatcgaatcactgaaggcccatgcaaatgcacgtgctgctgtactaaaagaacaactagaacgaaagagaaaggaggcttatgagagagaaaaaaaagtgtgggaagagcatttggtggctaaaggagttaagagttctgatgtttctccacctttgggacagcatgaaacaggtggctctccatcaaagcaacagatgagatctgttatttctgtaacttcagctttgaaagaagttggcgtggacagtagtttaactgatacccgggaaacttcagaagagatgcaaaagaccaacaatgctatttcaagtaagcgagaaatacttcgcagattaaatgaaaatcttaaagctcaagaagatgaaaaaggaatgcagaatctctctgatacttttgagataaatgttcatgaagatgccaaagagcatgaaaaagaaaaatcagtttcatctgatcgcaagaagtgggaggcaggaggtcaacttgtgattcctctggatgagttaacactagatacatccttctctacaactgaaagacatacagtgggagaagttattaaattaggtcctaatggatctccaagaagagcctgggggaaaagtccgacagattctgttctaaagatacttggagaagctgaactacaacttcagacagaactattagaaaatacaactattagaagtgagatttctcccgaaggggaaaagtacaaacccttaattactggagaaaaaaaagtacaatgtatttcacatgaaataaacccatcagctattgttgattctcctgttgagacaaaaagtcccgagttcagtgaggcatctccacagatgtcattgaaactggaaggaaatttagaagaacctgatgatttggaaacagaaattctacaagagccaagtggaacaaacaaagatgagagcttgccatgcactattactgatgtgtggattagtgaggaaaaagaaacaaaggaaactcagtcggcagataggatcaccattcaggaaaatgaagtttctgaagatggagtctcgagtactgtggaccaacttagtgacattcatatagagcctggaaccaatgattctcagcactctaaatgtgatgtagataagtctgtgcaaccggaaccatttttccataaggtggttcattctgaacacttgaacttagtccctcaagttcaatcagttcagtgttcaccagaagaatcctttgcatttcgatctcactcgcatttaccaccaaaaaataaaaacaagaattccttgctgattggactttcaactggtctgtttgatgcaaacaacccaaagatgttaaggacatgttcacttccagatctctcaaagctgttcagaacccttatggatgttcccaccgtaggagatgttcgtcaagacaatcttgaaatagatgaaattaaagatgaaaacattaaagaaggaccttctgattctgaagacattgtgtttgaagaaactgacacagatttacaagagctgcaggcctcgatggaacagttacttagggaacaacctggtgaagaatacagtgaagaagaagagtcagtcttgaagaacagtgatgtggagccaactgcaaatgggacagatgtggcagatgaagatgacaatcccagtagtgaaagtgccctgaacgaagaatggcactcagataacagtgatggtgaaattgctagtgaatgtgaatgcgatagtgtctttaaccatttagaggaactgagacttcatctggagcaggaaatgggctttgaaaaattctttgaggtttatgagaaaataaaggctattcatgaagatgaagatgaaaatattgaaatttgttcaaaaatagttcaaaatattttgggaaatgaacatcagcatctttatgccaagattcttcatttagtcatggcagatggagcctaccaagaagataatgatgaataa

SEQ ID NO: 124 - protein, 1214 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGMQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIKDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 125 - DNA, 1471 bp, Homo sapiens
  CDS (53)...(1324)
tgacttggatgtagacctcgaccttcacaggactcttcattgctggttggcaatgatgtatcggccagatgtggtgagggctaggaaaagagtttgttgggaaccctgggttatcggcctcgtcatcttcatatccctgattgtcctggcagtgtgcattggactcactgttcattatgtgagatataatcaaaagaagacctacaattactatagcacattgtcatttacaactgacaaactatatgctgagtttggcagagaggcttctaacaattttacagaaatgagccagagacttgaatcaatggtgaaaaatgcattttataaatctccattaagggaagaatttgtcaagtctcaggttatcaagttcagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaaaaatcaacaagacagaaacagacagctatctaaaccattgctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcaaaaaaaaaa

SEQ ID NO: 126 - protein, 423 aa, Homo sapiens
MMYRPDVVRARKRVCWEPWVIGLVIFISLIVLAVCIGLTVHYVRYNQKKTYNYYSTLSFTTDKLYAEFGREASNNFTEMSQRLESMVKNAFYKSPLREEFVKSQVIKFSQQKHGVLAHMLLICRFHSTEDPETVDKIVQLVLHEKLQDAVGPPKVDPHSVKIKKINKTETDSYLNHCCGTRRSKTLGQSLRIVGGTEVEEGEWPWQASLQWDGSHRCGATLINATWLVSAAHCFTTYKNPARWTASFGVTIKPSKMKRGLRRIIVHEKYKHPSHDYDISLAELSSPVPYTNAVHRVCLPDASYEFQPGDVMFVTGFGALKNDGYSQNHLRQAQVTLIDATTCNEPQAYNDAITPRMLCAGSLEGKTDACQGDSGGPLVSSDARDIWYLAGIVSWGDECAKPNKPGVYTRVTALRDWITSKTGI

SEQ ID NO: 127 - DNA, 1907 bp, Homo sapiens
  CDS (217)...(1530)
cccaagaccaagtcgtaatagcaacttcccttcctcagctgcctgaactttttttttcccttgtagctggagagaagtgtcacattttgctcactctcaaccttcctcgcccacccccttcccggagaacctgtgcggtgtgtagagggtgctgtgagccacctccagcctcgggtggctgcttaagtaactttcaactcctctcttcttaacactatgaagtgtctcgggaagcgcaggggccaggcagctgctttcctgcctctttgctggctctttttgaagattctgcaaccggggcacagccacctttataacaaccgctatgctggtgataaagtgataagatttattcccaaaacagaagaggaagcatatgcactgaagaaaatatcctatcaacttaaggtggacctgtggcagcccagcagtatctcctatgtatcagagggaacagttactgatgtccatatcccccaaaatggttcccgagccctgttagccttcttacaggaagccaacatccagtacaaggtcctcatagaagatcttcagaaaacactggagaagggaagcagcttgcacacccagagaaaccgaagatccctctctggatataattatgaagtttatcactccttagaagaaattcaaaattggatgcatcatctgaataaaactcactcaggcctcattcacatgttctctattggaagatcatatgagggaagatgtctttttattttaaagctgggcagacgatcacgactcaaaagagctgtttggatagactgtggtattcatgcaagagaatggattggtcctgccttttgtcagtggtttgtaaaagaagctcttctaacatataagagtgacccagccatgagaaaaatgttgaatcatctatatttctatatcatgcctgtgtttaacgtcgatggataccattttagttggaccaatgatcgattttggagaaaaacaaggtcaaggaactcaaggtttcgctgccgtggagtggatgccaatagaaactggaaagtgaagtggtgtgatgaaggagcttctatgcacccttgtgatgacacatactgtggcccttttccagaatctgagccggaagtgaaggctgtagctaacttccttcgaaaacacagaaagcacattagggcttatctctcctttcatgcatatgctcagatgttactgtatccctattcttacaaatatgcaacaattcccaattttagatgtgtggaatctgcagcttataaagctgtgaatgcacttcagtcagtatacggggtacgatacagatatggaccagcctccacaacgttgtatgtgagctctggtagctcaatggattgggcctacaaaaatggaataccttatgcatttgctttcgaactacgtgacactggatattttggatttttactcccagagatgctcatcaaacccacctgtacagaaactatgctggctgtgaaaaatatcacaatgcacctgctaaagaaatgtccctgagacagcccaaggctcaggtcaactgccataggattctgagcaaggcctacttggccctggatagaaattgttttcaaagagaagggcagctgcttagagtgaacatgtctatggactttaaaaagaccccacgcaatttgactttgtggcaatagaaaacagtaaaaaacagggcatagcctagtttgttataagaaaaagcatccattttctatccttttagagtcttatttgattatggtgggagggaatgttttcaaatttcccatttctcaagaaatgttcatattaattgaggatttcccttcaataaatctcatgtcctcaattataaaaaaaaaaaaaaaaaaaaaaaaaaaaaaaaaaaaaaaaaaaaa

SEQ ID NO: 128 - protein, 437 aa, Homo sapiens
MKCLGKRRGQAAAFLPLCWLFLKILQPGHSHLYNNRYAGDKVIRFIPKTEEEAYALKKISYQLKVDLWQPSSISYVSEGTVTDVHIPQNGSRALLAFLQEANIQYKVLIEDLQKTLEKGSSLHTQRNRRSLSGYNYEVYHSLEEIQNWMHHLNKTHSGLIHMFSIGRSYEGRCLFILKLGRRSRLKRAVWIDCGIHAREWIGPAFCQWFVKEALLTYKSDPAMRKMLNHLYFYIMPVFNVDGYHFSWTNDRFWRKTRSRNSRFRCRGVDANRNWKVKWCDEGASMHPCDDTYCGPFPESEPEVKAVANFLRKHRKHIRAYLSFHAYAQMLLYPYSYKYATIPNFRCVESAAYKAVNALQSVYGVRYRYGPASTTLYVSSGSSMDWAYKNGIPYAFAFELRDTGYFGFLLPEMLIKPTCTETMLAVKNITMHLLKKCP

SEQ ID NO: 129 - DNA, 2530 bp, Homo sapiens
  CDS (186)...(1199)
  misc_feature (1)...(2530): n = A,T,C or G
gtcgacccacgcgtccgcgggaggccgcctgaggctccggggtggccgcgcgccctcctgggagccatggcggctggggccgggggtcgccgggcggcggcggcgccgaggggctgagccggccgcgggcagcgccatggcggcgccgggttgcggaccctgagcgccggcgcggggcgcgcaccatgaactcgtgggacgcgggcctggcggggctactggtgggcacgatgggcgtctcgctgctgtccaacgcgctggtgctgctctgcctgctgcacagcgcggacatccgccgccaggcgccggcgctcttcaccctgaacctcacgtgcgggaacctgctgtgcaccgtggtcaacatgccgctcacgctggccggcgtcgtggcgcggcggcagccggcgggcgaccgcctgtgccgcctggctgccttcctcgacaccttcctggctgccaactccatgctcagcatggccgcgctcagcatcgaccgctgggtggccgtggtcttcccgctgagctaccgggccaagatgcgcctccgcgacgcggcgctcatggtggcctacacgtggctgcacgcgctcaccttcccagccgccgcgctcgccctgtcctggctcggcttccaccagctgtacgcctcgtgcacgctgtgcagccggcggccggacgagcgcctgcgcttcgccgtcttcactggcgccttccacgctctcagcttcctgctctccttcgtcgtgctctgctgcacgtacctcaaggtgctcaaggtggcccgcttccattgcaagcgcatcgacgtgatcaccatgcagacgctcgtgctgctggtggacctgcaccccagtgtgcgggaacgctgtctggaggagcagaagcggaggcgacagcgagccaccaagaagatcagcaccttcatagggaccttccttgtgtgcttcgcgccctatgtgatcaccaggctagtggagctcttctccacggtgcccatcggctcccactggggggtgctgtccaagtgcttggcgtacagcaaggccgcatccgacccctttgtgtactccttactgcgacaccagtaccgcaaaagctgcaaggagattctgaacaggctcctgcacagacgctccatccactcctctggcctcacaggcgactctcacagccagaacattctgccggtgtctgagtgaaggaccgcgctcctgctgaagagtttagaatgaggcagcggtgagaagaagggtgggagggcgtgggggcccctgggtggacaccaccagccaccagtccctggcatgcccagatgatcctggttccctggcttgtaggggctccagagcctgcttcctggttcctcaagggcagatattggacacttccttatttgtcaccaaaggaatgactgtaggccgtgtgttggcccttctttctaagaagctgctttgagctcctggactcacctgaggctccctgggggatgacactcagttctgtcactgtcaaggatgcagagagctggtggtaggtgggaagcatggtgtccacctgcctgctgaccactggacgctgctccatgctgaagaaaagtgacagtctccaggggacatttcagccatgctgaaagggaggctggcagtggtcawttggcccggatctaacatggcacctcgtctccacagggtagtggtggctgcttcaacccaaatattattcagctggtactaacgacattgtgcccagctgggactcttgggctctgtgcctgagggaaaatgtttcacaactagtggctgcccaattgctgctgaccagttgtcttagaaatggtcaattggattcaactttagtcctctccttccccctaaaagcgaatgtttgtgtgtgcagacaatcttagcatgaaaatggtttaaataggctggtcctacatgtattaggttctttcaagtttgactgggaggtcacctttttctgatttacaagtcctaattgttggagctcagtaaaggtaggaggaaggtggctggttggtcctcccttccccctgtttgtgacctgaatttacaggaagtgtttcaacttgtcttatgcatcttatctggcatgtcctgggagatggatgggcaagaactggcctgagcagggatttttgccttgattttaagtcactgggttccattgtcctggcacctccatttccttagtttctgtaagcctgttaacagaaagtagaggctattcaaggttatcaagaaagtgccctgtgctaatgatgagacagtgaatttttttttttttcragatgggagtttcactcttattgcccaggctagagtgcaatggtgcgatctaggctcaccgcaacctctgccttccaggttcaagtgattagagacagtgaaatttttatggaatactgcacctataaaacacatgccaatctgttagcagtcctgacttgatttaataaaaaccaaggagagccaaaaaaaaaaaaaaaaaaaaaaaaaaaaangggcgg

SEQ ID NO: 130 - protein, 337 aa, Homo sapiens
MNSWDAGLAGLLVGTMGVSLLSNALVLLCLLHSADIRRQAPALFTLNLTCGNLLCTVVNMPLTLAGVVARRQPAGDRLCRLAAFLDTFLAANSMLSMAALSIDRWVAVVFPLSYRAKMRLRDAALMVAYTWLHALTFPAAALALSWLGFHQLYASCTLCSRRPDERLRFAVFTGAFHALSFLLSFVVLCCTYLKVLKVARFHCKRIDVITMQTLVLLVDLHPSVRERCLEEQKRRRQRATKKISTFIGTFLVCFAPYVITRLVELFSTVPIGSHWGVLSKCLAYSKAASDPFVYSLLRHQYRKSCKEILNRLLHRRSIHSSGLTGDSHSQNILPVSE

SEQ ID NO: 131 - DNA, 2699 bp, Homo sapiens
  CDS (299)...(1636)
ccacgcgtccgccggctgcacggtcgcaccggcagcggctcaggctccggctcctctcccgctgcagcagccgcgctgccggccccactgggctcggatccggccccggccccctcggcaccgcctgctctggccccggccccggccccgcggaccatgcgctgggcgcccccaggggaaacccgacccggccaagggcccgcaaagacgaggctcccgggccggggcccctcccggccgcccagctctcggccggcgccctgccccgcgtcccggagccgcgtgagcctgcggggccatggagcgcgcgccgcccgacgggccgctgaacgcttcgggggcgctggcgggcgatgcggcggcggcgggcggggcgcgcggcttctcggcagcctggaccgcggtgctggccgcgctcatggcgctgctcatcgtggccacggtgctgggcaacgcgctggtcatgctcgccttcgtggccgactcgagcctccgcacccagaacaacttcttcctgctcaacctcgccatctccgacttcctcgtcggcgccttctgcatcccactgtatgtaccctacgtgctgacaggccgctggaccttcggccggggcctctgcaagctgtggctggtagtggactacctgctgtgcacctcctctgccttcaacatcgtgctcatcagctacgaccgcttcctgtcggtcacccgagcggtctcataccgggcccagcagggtgacacgcggcgggcagtgcggaagatgctgctggtgtgggtgctggccttcctgctgtacggaccagccatcctgagctgggagtacctgtccgggggcagctccatccccgagggccactgctatgccgagttcttctacaactggtacttcctcatcacggcttccaccctggagttctttacgcccttcctcagcgtcaccttctttaacctcagcatctacctgaacatccagaggcgcacccgcctccggctggatggggctcgagaggcagccggccccgagccccctcccgaggcccagccctcaccacccccaccgcctggctgctggggctgctggcagaaggggcacggggaggccatgccgctgcacaggtatggggtgggtgaggcggccgtaggcgctgaggccggggaggcgaccctcgggggtggcggtgggggcggctccgtggcttcacccacctccagctccggcagctcctcgaggggcactgagaggccgcgctcactcaagaggggctccaagccgtcggcgtcctcggcctcgctggagaagcgcatgaagatggtgtcccagagcttcacccagcgctttcggctgtctcgggacaggaaagtggccaagtcgctggccgtcatcgtgagcatctttgggctctgctgggccccatacacgctgctgatgatcatccgggccgcctgccatggccactgcgtccctgactactggtacgaaacctccttctggctcctgtgggccaactcggctgtcaaccctgtcctctaccctctgtgccaccacagcttccgccgggccttcaccaagctgctctgcccccagaagctcaaaatccagccccacagctccctggagcactgctggaagtgagtggcccaccagagcctccctcagccacgcctctctcagcccaggtctcctgggcatctggccctgctgccccctacccggctcgttcccccaggggtgagccccgccgtgtctgtggccctctcttaatgccacggcagccaccctgccatggaggcgccttcctgggttggccagagggcccctcactggctggactggaggctgggtggccggccctgccccccacattctggctccaccggggagggacagtctggaggtcccagacatgctgcccaccccctgctggtgcccacccttcgcagttactggttggtgttcttcccaaagcaagcacctgggtgtgctccaggcttcctgccctagcagtttgcctctgcacgtgcacacacctgcacacccctgcacacacctgcacaccgtccctctccccggacaagcccaggacactgcctttgctgccttctgtctcttgcataagcctcaggcctggccctttcacccctcttcccaccaactctctctgcccccaaaagtgtcaaggggccctaggaacctcgaagctgttctctgcttttccattctgggtgttttcagaaagatgaagaagaaaacatgtctgtgaacttgatgttcgtgggatgtttaatcaagagagacaaaattgctgaggagctcagggctggattggcaggtgtgggctcccacgccctcctccctccgctaaggcttccggctgagctgtgccagctgcttctgcccaccccgcctctgggctcacaccagccctggtggccaagcctgccccggccactctgtttgctcacccaggacctctgggggttgttgggaggagggggcccggctgggcccgagggtcccaaggcgtgcaggggcggtccagaggaggtgcccgggcaggggccgcttcgccatgtgctgtgcacccgtgccacgcgctctgcatgctcctctgcctgtgcccgctgcgctgccctgcaaaccgtgaggtcacaataaagtgtatttttttaaaaaaaaaaaaaaaaaaaaaaaaaaa

SEQ ID NO: 132 - protein, 445 aa, Homo sapiens
MERAPPDGPLNASGALAGDAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 133 - DNA, 3923 bp, Homo sapiens
  CDS (230)...(1954)
gagccagcgagccagcgcgcgcgggcgggcggacagatcggagccgagcggggccgggcggggcgctccctgcagggctctgcgcggcgtgccgcggcggccgcgggctccggccccgggccatgagcccctccgcgactcggcgctgagcccgccaccggtccagcgccccaggacccgccgccggctgccggcttgccgaagccccctcaggatcccctcaacaaggatggaactgaaggccgaggaggaggaggtgggtggcgtccagccggtgagcatccaggccttcgccagcagctccacactgcacggcctggcccacatcttctcctacgagcggctgtctctgaagcgggcactgtgggccctgtgcttcctgggctcgctggctgtgctgctgtgtgtgtgcacggagcgtgtgcagtactacttccactaccaccatgtcaccaagctcgacgaggtggctgcctctcagcttaccttccctgctgtcacgctgtgcaacctcaacgagttccgctttagccaagtctccaagaatgacctgtatcatgctggggagctgctggccctgctcaacaacaggtatgagataccagacacacagatggcagatgaaaagcagctggagatactgcaggacaaagccaacttccgcagcttcaaacccaaacccttcaacatgcgtgagttctacgaccgagctgggcacgacattcgagacatgctgctctcctgccacttccggggggaggtctgcagcgctgaagacttcaaggtggtcttcacacgctatggaaagtgctacacgttcaactcgggccgagatgggcggccgcggctgaagaccatgaaggatgggacgggcaatgggctggaaatcatgctggacatccagcaggacgagtacctgcctgtgtggggggagactgacgagacgtccttcgaagcaggcatcaaagtgcagatccatagtcaggatgaacctcctttcatcgaccagctgggctttggcgtggccccaggcttccagacctttgtggcctgccaggagcagcggctcatctacctgcccccaccctggggcacctgcaaagctgttaccatggactcggatttggatttcttcgactcctacagcatcactgcctgccgcatcgactgtgagacgcgctacctggtggagaactgcaactgccgcatggtgcacatgccaggggatgccccatactgtactccagagcagtacaaggagtgtgcagatcctgctctggacttcctggtggagaaggaccaggagtactgcgtgtgtgaaatgccttgcaacctgacccgctatggcaaagagctgtccatggtcaagatccccagcaaagcctcagccaagtacctggccaagaagttcaacaaatctgagcaatacataggggagaacatcctggtgctggacattttctttgaagtcctcaactatgagaccattgaacagaagaaggcctatgagattgcagggctcctgggtgagctgctgatgacacctgtccccttctcatgccatgggcatggcgtggctccctatcatccaaaagcagggtgctcacttctgtcccatgagggtcctccaccccagaggcccttccccaaaccctgttgtcttggtgacatcgggggccagatggggctgttcatcggggccagcatcctcacggtgctggagctctttgactacgcctacgaggtcattaagcacaagctgtgccgacgaggaaaatgccagaaggaggccaaaaggagcagtgcggacaagggcgtggccctcagcctggacgacgtcaaaagacacaacccgtgcgagagccttcggggccaccctgccgggatgacatacgctgccaacatcctacctcaccatccggcccgaggcacgttcgaggactttacctgctgagccccgcaggccgctgaaccaaaggcctagatggggaggactaggagagcgrgggggcccccagctgcctcctcacatctgccctgggractccccacactccggggcagatctttcctcttgtctgtggtaaggaaggagtcttgaccatagagtcctctctctgcctctatcccattcyttttacatttaacaaaactaatctaaaaaagaactaaaaagggagaacggggcaagggacctcaggctgcccctctctcctccatgctgcctcccctagctcccagcctgaattctgtctatctagctgtctgccatctgagtgtccatctacattctgctgccaccagtcaccaaaggcccttcccagtgaggggtggaagggatctctggggtctggaatttggccccaaaccagagaatgtaccttaagggggagggctagtgtgggggagggaggcttccccagccttaagagaccctctcagcccagtgactgtccccaaacccaagtctcctggcaggaactaaaacctcagccccactctctcacaccatgtggaatctcgtgggggtcggggatccccttaagaagtggtaatggggacaagatgcggccctggtgctgtaggctacatcctgatacctataagttcacccccaccccacagctgctggagagaaatcccaagaggcagcccttcctcaccatcccattaaagacckggctggttagcgtccagctcagggagaagggcgctagtgcctaacctcactggtccctctcccggaggcccttgtagagggccacgtccataaattttcttatggaactctcccacatcctcttccccaacttcatttgcttctctcaacaacctcatctgcattttctatttctatatgatacagactctatattgctatatctctgtatatactttcccagccctgtctgtctccaccccatcccctcttgtctctgagaaccattctcccaccccaagttccaccttctatgtttctactccctccctggtctctgaatgccttygcctgtataaagagttggactctctcccctggtgtctgtactgtgtacacacatccctctgagaagcacaaggagacgacacgcgcattgtaacctttgcactgtctcagtggcgacaaaggaagctgtgaatcacaagctctgcctctttctggcctcaccctctcccccaacccgggcaccctcggccctccctgcagccttaacattctcttcccctgctcctcctatcccattgccctctgcccagctgacagtggcatccccagggaaggggttgctgtagagatagcccccacccaggggatggaggtctaccctggacactaagccaagtgtgtcagagacagaagggagctggggattggcgactcctgaagttggggcagtgggatgctgacaggcagaagctgaggtcctcagtcagtggcctttcctccttctgggtgcccagccccctttcctcacctgatacccaagcccaccacttttattttctggtgaggtgggtttgggaggaaagagaggcctagaggaggagttgaaagctctgctgttgtctcaccctatcttaatgagagacaagtgaggtggagggcctgccccccctccctccaccagacactccttccaggcctgagccccaacccctcttcaggccttccttccctagctgtgtcttggtcttcaatcccagaacaggacctgtgagcagctgcattggcctggagctggagagtaaggctgtaggatctttggaatctcttggttcctaagagtttcctcagagatcatacctccccagagggaagcaggaatgaggccaaaaagtgtgcattggataggggaacagcaggcagggctctgggtgacgcatgcctctggtctaataaactgggtttcaaccaaaaaaaa

SEQ ID NO: 134 - protein, 574 aa, Homo sapiens [sequence omitted]

SEQ ID NO: 135 - DNA, 2980 bp, Homo sapiens
  CDS (86)...(2422)
gtcgacccacgcgtccgcggacgcgtgggcggacgcgtgggcggacgcgtggggggggaccggtcgggccgggaccaagggcaccatgtcgtccggggccaaggagggaggtgggggctctcccgcctaccacctcccccacccccacccccacccaccccagcacgcccaatatgtgggcccctatcggctggagaagacgctgggcaaaggacagacagggctggttaaactcggggtccactgcatcacgggtcagaaggtcgccatcaagatcgtgaaccgggagaagctgtcggagtcggtgctgatgaaggtggagcgggagatcgccatcctgaagctcatcgaacacccacatgtcctcaagctccacgacgtctacgagaacaagaaatatttgtacctggttctggagcacgtctcggggggtgagctattcgactacctggtaaagaaggggagactgacgcccaaggaggcccgaaagttcttccgccagattgtgtctgcgctggacttctgccacagctactccatctgccacagagacctaaagcccgagaacctgcttttggatgagaaaaacaacatccgcattgcagacttcggcatggcgtccctgcaggtgggggacagcctcctggagaccagctgcgggtccccccattatgcgtgtccagaggtgattaagggggaaaaatatgatggccgccgggcagacatgtggagctgtggagtcatcctcttcgccctgctcgtgggggctctgccctttgatgacgacaacctccgccagctgctggagaaggtgaaacggggcgtcttccacatgccccacttcattcctccagattgccagagcctcctgaggggaatgatcgaagtggagcccgaaaaaaggctcagtctggagcaaattcagaaacatccttggtacctaggcgggaaacacgagccagacccgtgcctggagccagcccctggccgccgggtagccatgcggagcctgccatccaacggagagctggaccccgacgtcctagagagcatggcatcactgggctgcttcagggaccgcgagaggctgcatcgcgagctgcgcagtgaggaggagaaccaagaaaagatgatatattatctgcttttggatcggaaggagcggtatcccagctgtgaggaccaggacctgcctccccggaatgatgttgaccccccccggaagcgtgtggattctcccatgctgagccgtcacgggaagcggcgaccagagcggaagtccatggaagtcctgagcatcaccgatgccgggggtggtggctcccctgtacccacccgacgggccttggagatggcccagcacagccagagatcccgtagcgtcagtggagcctccacgggtctgtcctccagccctctaagcagcccaaggagtccggtcttttccttttcaccggagccgggggctggagatgaggctcgaggcgggggctccccgacttccaaaacgcagacgctgccttctcggggccccaggggtgggggcgccggggagcagcccccgccccccagtgcccgctccacacccctgcccggccccccaggctccccgcgctcctctggcgggacccccttgcactcgcctctgcacacgccccgggccagtcccaccgggaccccggggacaacaccaccccccagccccggcggtggcgtcgggggagccgcctggaggagtcgtctcaactccatccgcaacagcttcctgggctcccctcgctttcaccggcgcaagatgcaggtccctaccgctgaggagatgtccagcttgacgccagagtcctccccggagctggcaaaacgctcctggttcgggaacttcatctccttggacaaagaagaacaaatattcctcgtgctaaaggacaaacctctcagcagcatcaaagcagacatcgtccatgcctttctgtcgatccccagcctgagtcacagtgtgctgtcacagaccagcttcagggccgagtacaaggccagtggcggcccctccgtcttccaaaagcccgtccgcttccaggtggacatcagctcctctgagggtccagagccctccccgcgacgggacggcagcggaggtggtggcatctactccgtcaccttcactctcatctcgggtcccagccgtcggttcaagcgagtggtggagaccatccaggcacagctcctgagcactcatgaccagccctccgtgcaggccctggcagacgagaagaacggggcccagacccggcctgctggtgccccaccccgaagcctgcagcccccacccggccgcccagacccagagctgagcagctctccccgccgaggcccccccaaggacaagaagctcctggccaccaacgggacccctctgccctgaccccacggggccggggagggaggggacccccctccaccccccttccgtgccccccaactgtgaatctgtaaataaggcccaaggaacatgtcgggaggggggtggacacaaaaaccggccttgccctgcagggatggggctccacaggccgtgcccaactgggggtggttctaggggaacagggggcgggggagctgtttctattttatttattgattaatttattattttatttattgatcaatctctctgcggggtggggtgggggagggacgggagctggttggggtggcttagcagatccggacagggccctctgtccctgtgtcgtccccaaccccctcttcccgggcccctcctcccctggtcctccccccacgaccttctgtacggatttgctctccggaaggaattctggtttcgcgtgatcctgcctgcgtccgtgtctctgattccgccggcggcaaaaaaaaaaaaaaaaaaaaaaaaaaaaaaagataataataataaatagccttgatcagggaaaaaaaaaaaaaaaaaaaagggcggccgcta

SEQ ID NO: 136 - protein, 778 aa, Homo sapiens
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

What is claimed:

1. A method for identifying a compound capable of treating urinary incontinence, comprising:
   a) combining a compound to be tested with a sample comprising a polypeptide selected from the group consisting of:
      i) a polypeptide comprising the amino acid sequence of SEQ ID NO:104; and
      ii) a polypeptide encoded by the nucleotide sequence set forth in SEQ ID NO:103 under conditions suitable for binding of the compound to the polypeptide;
   b) detecting binding of the compound to the polypeptide to thereby identify a compound which binds to the polypeptide;
   c) determining the effect of the compound on urinary incontinence in an animal model of urinary incontinence; and
   d) identifying the compound as capable of treating urinary incontinence if the compound reduces urinary incontinence in the animal model.

2. The method of claim 1, wherein the compound is selected from the group consisting of a small molecule, a peptide or an antibody.

3. The method of claim 1, wherein the polypeptide further comprises heterologous sequences.

4. The method of claim 1, wherein the sample comprises the polypeptide, a membrane-bound form of the polypeptide or a cell comprising the polypeptide.

5. The method of claim 4, wherein the cell is selected from the group consisting of a bladder cell, a prostate cell, a kidney cell, a vascular cell, a urethral cell, a dorsal root ganglion cell, a trigeminal ganglion cell, a brain cell, and a spinal cord cell.

6. The method of claim 1, wherein the binding of the compound to the polypeptide is detected by a method selected from the group consisting of:
   a) a competition binding assay;
   b) an immunoassay; and
   c) a yeast two-hybrid assay.

7. The method of claim 1, wherein binding of the compound to the polypeptide is detected by an assay for an activity of the polypeptide selected from the group consisting of:
   a) a carboxypeptidase assay; and
   b) an assay for measuring proteolysis of extracellular peptides or proteins.

* * * * *